(12) United States Patent
Bhanot et al.

(10) Patent No.: US 11,312,962 B2
(45) Date of Patent: Apr. 26, 2022

(54) MODULATORS OF DIACYGLYCEROL ACYLTRANSFERASE 2 (DGAT2)

(71) Applicant: Ionis Pharmaceuticals, Inc., Carlsbad, CA (US)

(72) Inventors: Sanjay Bhanot, Carlsbad, CA (US); Susan M. Freier, San Diego, CA (US); Eric E. Swayze, Encinitas, CA (US)

(73) Assignee: Ionis Pharmaceuticals, Inc., Carlsbad, CA (US)

( * ) Notice: Subject to any disclaimer, the term of this patent is extended or adjusted under 35 U.S.C. 154(b) by 0 days.

(21) Appl. No.: 16/456,432

(22) Filed: Jun. 28, 2019

(65) Prior Publication Data

US 2020/0040341 A1    Feb. 6, 2020

Related U.S. Application Data

(63) Continuation of application No. 15/741,996, filed as application No. PCT/US2016/041410 on Jul. 8, 2016, now abandoned.

(60) Provisional application No. 62/191,231, filed on Jul. 10, 2015.

(51) Int. Cl.
*C12N 15/113* (2010.01)
*C07H 21/00* (2006.01)
*A61P 1/16* (2006.01)

(52) U.S. Cl.
CPC ............ *C12N 15/1137* (2013.01); *A61P 1/16* (2018.01); *C07H 21/00* (2013.01); *C12Y 203/0102* (2013.01); *C12N 2310/11* (2013.01); *C12N 2310/315* (2013.01); *C12N 2310/3341* (2013.01); *C12N 2310/341* (2013.01); *C12N 2310/346* (2013.01); *C12N 2320/35* (2013.01)

(58) Field of Classification Search
CPC ... A61P 1/16; C12N 15/1137; C12N 2310/11; C12N 2310/31; C12N 2310/346; C12N 2310/3525
USPC .............. 435/6.1, 91.1, 91.31, 455, 458; 514/44 A; 536/23.1, 24.5
See application file for complete search history.

(56) References Cited

U.S. PATENT DOCUMENTS

| | | | |
|---|---|---|---|
| 4,035,504 A | 7/1977 | Hidy et al. | |
| 5,801,154 A | 9/1998 | Baracchini et al. | |
| 5,837,542 A | 11/1998 | Grimm et al. | |
| 5,998,148 A | 12/1999 | Bennett et al. | |
| 6,083,695 A | 7/2000 | Hardin et al. | |
| 6,100,077 A | 8/2000 | Sturley et al. | |
| 6,127,533 A | 10/2000 | Cook et al. | |
| 6,284,538 B1 | 9/2001 | Monia et al. | |
| 6,344,548 B1 | 2/2002 | Farese, Jr. et al. | |
| 6,444,427 B1 | 9/2002 | Ludwig et al. | |
| 6,512,099 B2 | 1/2003 | Omura et al. | |
| 6,582,908 B2 | 6/2003 | Fodor et al. | |
| 6,605,451 B1 | 8/2003 | Marmaro et al. | |
| 6,607,893 B2 | 8/2003 | Ramharack et al. | |
| 6,673,661 B1 | 1/2004 | Liu et al. | |
| 6,822,141 B2 | 11/2004 | Lardizabal et al. | |
| 7,250,289 B2 | 7/2007 | Zhou | |
| 7,250,496 B2 | 7/2007 | Bentwich | |
| 7,691,997 B2 | 4/2010 | Khvorova et al. | |
| 8,258,289 B2 | 9/2012 | Bhanot et al. | |
| 2001/0053519 A1 | 12/2001 | Fodor et al. | |
| 2002/0119138 A1 | 8/2002 | Cases et al. | |
| 2002/0127627 A1 | 9/2002 | Ramharack et al. | |
| 2002/0193315 A1 | 12/2002 | Omura et al. | |
| 2003/0028923 A1 | 2/2003 | Lardizabal et al. | |
| 2003/0073103 A1 | 4/2003 | Ludwig et al. | |
| 2003/0100480 A1 | 5/2003 | Smith et al. | |
| 2003/0104414 A1 | 6/2003 | Attersand | |
| 2003/0115632 A1 | 6/2003 | Lardizabal et al. | |
| 2003/0124126 A1 | 7/2003 | Cases et al. | |
| 2003/0152574 A1 | 8/2003 | Logan et al. | |
| 2003/0161831 A1 | 8/2003 | Cases et al. | |
| 2003/0170691 A1 | 9/2003 | Gimeno et al. | |
| 2003/0200563 A1 | 10/2003 | Butler et al. | |
| 2003/0202968 A1 | 10/2003 | Cases et al. | |
| 2003/0228597 A1 | 12/2003 | Cowsert et al. | |
| 2004/0054177 A1 | 3/2004 | Otake et al. | |
| 2004/0058820 A1 | 3/2004 | Hagmann et al. | |
| 2004/0009745 A1 | 5/2004 | Dobie et al. | |
| 2004/0012203 A1 | 6/2004 | Nargund et al. | |
| 2004/0259247 A1 | 12/2004 | Tuschl et al. | |
| 2005/0043524 A1 | 2/2005 | Bhanot et al. | |
| 2005/0272680 A1 | 12/2005 | Bhanot et al. | |
| 2007/0031844 A1 | 2/2007 | Khvorova et al. | |
| 2013/0123331 A1 | 5/2013 | Bhanot et al. | |
| 2016/0025165 A1 | 9/2016 | Freier et al. | |

FOREIGN PATENT DOCUMENTS

| | | |
|---|---|---|
| EP | 1308459 A2 | 5/2003 |
| WO | WO 00/62774 | 10/2000 |
| WO | WO 00/78961 | 12/2000 |
| WO | WO 01/068848 | 9/2001 |
| WO | WO 01/077389 | 10/2001 |

(Continued)

OTHER PUBLICATIONS

Extended EP Search Report for 16824926.6 dated Mar. 13, 2019.

(Continued)

*Primary Examiner* — Jane J Zara
(74) *Attorney, Agent, or Firm* — Knobbe, Martens, Olson & Bear, LLP

(57) ABSTRACT

The present embodiments provide methods, compounds, and compositions useful for inhibiting DGAT2 expression, which may be useful for treating, preventing, or ameliorating a disease associated with DGAT2.

7 Claims, No Drawings

Specification includes a Sequence Listing.

(56) References Cited

FOREIGN PATENT DOCUMENTS

| | | |
|---|---|---|
| WO | WO 01/092512 | 12/2001 |
| WO | WO 02/008260 | 1/2002 |
| WO | WO 02/22635 | 3/2002 |
| WO | WO 02/068595 | 9/2002 |
| WO | WO 03/053363 | 7/2003 |
| WO | WO 2004/094636 | 11/2004 |
| WO | WO 2005/019418 | 3/2005 |
| WO | WO 2008/150729 | 12/2008 |
| WO | WO 2008/154401 | 12/2008 |
| WO | WO 2009/006478 | 1/2009 |
| WO | WO 2012/135736 | 10/2012 |
| WO | WO 2013/192233 | 12/2013 |
| WO | WO 2014/179627 | 11/2014 |
| WO | WO 2015/054676 | 4/2015 |

OTHER PUBLICATIONS

Branch et al., "A good antisense molecule is hard to find" TIBS (1998) 23:45-50.
Buhman et al., "DGAT1 is not essential for intestinal triacylglycerol absorption or chylomicron synthesis" J. Biol. Chem. (2002) 277:25474-25479.
Byrne et al., "NAFLD: a multisystem disease" J Hepatol (2015): S47-S64.
Cao et al., "Catalytic properties of MGAT3, a putative triacylgycerol synthase" J Lipid Res (2007) 48(3): 583-591.
Cases et al., "Identification of a gene encoding an acyl CoA: diacylglycerol acyltransferase, a key enzyme in triacylglycerol synthesis" Proc. Natl. Acad. Sci. (1998) 95:13018-13023.
Cases et al., "Cloning of DGAT2, a second mammalian diacylglycerol acyltransferase, and related family members" J. Biol. Chem. (2001) 276:38870-38876.
Chan et al., "Clinical classification and treatment of congenital and acquired lipodystrophy" Endocr Pract (2010) 16(2): 310-323.
Charlton et al., "Frequency and outcomes of liver transplantation for nonalcoholic steatohepatitis in the United States" Gastroenterology (2011) 141(4): 1249-1253.
Chen et al., "Increased insulin and leptin sensitivity in mice lacking acyl CoA:diacylglycerol acyltransferase 1" J. Clin. Invest. (2002) 109:1049-1055.
Chen et al., "Leptin modulates the effects of acyl CoA: diacylglycerol acyluansferase deficiency on murine fur and sebaceuous glands" J. Clin. Invest. (2002) 109:175-181.
Cheng et al., "Human acyl-CoA: diacylglycerol acyltransferase is a tetrameric protein" Biochem. J. (2001) 359:707-714.
Cheng et al., "Acylation of acylglycerols by acyl coenzyme A:diacylglycerol acyltransferase 1 (DGAT1). Functional importance of DGAT1 in the intestinal fat absorption" J Biol Chem (2008) 283(44): 29802-29811.
Chin, "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Cohen et al., "Human fatty liver disease: old questions and new insights" Science (2011) 332(6037): 1519-1523.
Crooke et al., "Basic Principles of Antisense Therapeutics" Antisense Research and Application (1998) Chapter 1:1-50.
Desai et al., "Phenotypic Correction of Diabetic Mice by Adenovirus-Mediated Glucokinase Expression" Diabetes (2001) 50:2287-2295.
Egli et al., "Synthesis, improved antisense activity and structural rationale for the divergent RNA affinities of 3'-fluoro hexitol nucleic acid (FHNA and Ara-FHNA) modified oligonucleotides" J Am Chem Soc (2011) 133(41): 16642-16649.
Farese et al., "Triglyceride synthesis: insights from the cloning of diacylglycerol acyltransferase" Curr. Opin. Lipidol. (2000) 11:229-234.
Farrell et al., "Nonalcoholic fatty liver disease: from steatosis to cirrhosis" Hepatology (2006)43(2): S99-S112.

Garg "Clinical review#: Lipodystrophies: genetic and acquired body fat disorders" J Clin Endocrinol Metlab (2011) 96(11): 3313-3325.
Garg "Acquired and inherited lipodystrophies" N Engl J Med (2004) 350(12): 1220-1234.
Gautschi et al., "Activity of a novel bcl-2/bcl-xL-bispecific antisense oligonucleotide against tumors of diverse histologic origins" J Natl Cancer Inst (2001) 93(6): 463-471.
Guo et al., "par-1, a Gene Required for Establishing Polarity in C. elegans Embryos, Encodes a Putative Ser/Thr Kinase that is Asymmetrically Distributed" Cell (1995) 81:611-620.
Handelsman et al., "The clinical approach to the detection of lipodystrophy—an AACE consensus statement" Endocr Pract (2013) 19(1): 107-116.
Huang-Doran et al., "Lipodystrophy: metabolic insights from a rare disorder" J Endocrinol (2010) 207(3): 245-255.
Lardizabal et al., "DGAT2 is a new diacylglycerol acyltransferase gene family: purification, cloning, and expression in insect cells of two polypeptides from Mortierella ramanniana with diacylglycerol acyltransferase activity" J. Biol. Chem. (2001) 276:38862-38869.
Ludwig et al., "DGAT1 promotor polymorphism associated with alterations in body mass index, high density lipoprotein levels and blood pressure in Turkish, women" Clin. Genet. (2002) 62:68-73.
Maher et al., "Comparative hybrid arrest by tandem antisense oligodeoxyribonucleotides or oligodeoxyribonucleoside methylphosphonates in a cell-free system" Nucleic Acids Res (1988) 16(8): 3341-3358.
Maier et al., "Synthesis of antisense oligonucleotides conjugated to a multivalent carbohydrate cluster for cellular targeting" Bioconjug Chem (2003) 14(1): 18-29.
Marchesini et al., "Nonalcoholic fatty liver, steatohepatitis, and the metabolic syndrome" Hepatology (2003) 37(4): 917-923.
Martin, "Ein Neuer Zugang Zu 2'-0-Alkylribonucleosiden Und Eigenschaften Deren Oligonucleotide" Helvetica Chimica Acta (1995) 78:486-504.
McCullough "Pathophysiology of nonalcoholic steatohepatitis" J Clin Gastroenterol (2006) 40(1): S17-S29.
Meegalla et al., "Concerted elevation of acyl-coenzyme A:diacylglycerol acyltransferase (DGAT) activity through independent stimulation of mRNA expression of DGAT1 and DGAT2 by carbohydrate and insulin" Biochem. Biophys. Res. Comm. (2002) 298:317-323.
Melo et al., "Genetic therapies for cardiovascular diseases." Trends in Molecular Medicine, 2005, 11:240-250.
Montgomery et al., "RNA as a target of double-stranded RNA-mediated genetic interference in Caenorhabditis elegans" Proc. Natl Acad. Sci. (1998) 95:15502-15507.
New England Biolabs 1998/1999 Catalog, cover page, pp. 121 and 284.
Oelkers et al., "Characterization of two human genes encoding acyl coenzyme A: cholesterol acyltransferase-related enzymes" J. Biol. Chem. (1998) 273:26765-26771.
Rensen et al., "Design and synthesis of novel N-acetylgalactosamine-terminated glycolipids for targeting of lipoproteins to the hepatic asialoglycoprotein receptor" J Med Chem (2004) 47(23): 5798-5808.
Reynolds et al., "Rational siRNA design for RNA interference" Nature Biotechnology (2004) 22(3):326-330.
Sanghvi et al., "Heterocyclic Base Modifications in Nucleic Acids and Their Applications in Antisense Oligonucleotides" Antisense Research and Applications (1993) pp. 273-288.
Seth et al., "Short antisense oligonucleotides with novel 2'-4' conformationaly restricted nucleoside analogues show improved potency without increased toxicity in animals" J Med Chem (2009) 52(1): 10-13.
Shulman "Ectopic fat in insulin resistance, dyslipidemia, and cardiometabolic disease" N Engl J Med (2014) 371(12): 1131-1141.
Smith et al., "Obesity resistance and multiple mechanisms of triglyceride synthesis in mice lacking Dgat" Nat. Genet. (2000)25:87-90.
Stone et al., "Lipopenia and Skin Barrier Abnormalities in DGAT2-deficient Mice" J. Biol. Chem. (2004) 279(12):11767-11776.
Tabata et al., "Xanthohumols, diacylglycerol acyltransferase inhibitors, from Humulus lupulus" Phytochemistry (1997) 46:683-687.

(56) References Cited

OTHER PUBLICATIONS

Tusterman et al., "RNA Helicase MUT-14-Dependent Gene Silencing Triggered in C. elegans by Short Antisense RNAs" Science (2002) 295:694-697.
Tomoda et al., "Roselipins, inhibitors of diacylglycerol acyltransferase, produced by Gliocladium roseum KF-1040" J. Antibiot. Tokyo (1999) 52:689-694.
Vaughan et al., "Tumors and the heart: molecular genetic advances." Current Opinions in Cardiology, 2001, 16:195-200.
Waterman et al., "Distinct ontogenic patterns of overt and latent DGAT activities of rat liver microsomes" J. Lipid Res. (2002) 43:1555-1562.
Williams et al., "Prevalence of nonalcoholic fatty liver disease and nonalcoholic steatohepatitis among a largely middle-aged population utilizing ultrasound and liver biopsy: a prospective study" Gastroenterology (2011) 140(1): 124-131.
Woolf et al., "Specificity of antisense oligonucleotides in vivo" Proc Natl Acad Sci USA (1992) 89(16): 7305-7309.
Yamaguchi et al., "Inhibiting Triglyceride Synthesis Improves Hepatic Steatosis but Exacerbates Liver Damage and Fibrosis in Obese Mice with Nonalcoholic Steatohepatitis" Hepatology (2007) 45:1366-1374.
Yu et al., "Posttranscriptional control of the expression and function of diacylglycerol acyltransferase-1 in mouse adipocytes" J. Biol. Chem. (2002) 277:50876-50884.
Yu et al., "Antisense Oligonucleotide Inhibition of DGAT2 Expression Reduced Hepatic Steatosis and Hyperlipidemia in Diet-Induced Obese Mice" Obesity Res. (2003) NAASO's 2003 Annual Meeting, Oct. 11-15, 2011:A48.
Yu et al., "Antisense Oligonucleotide Reduction of DGAT2 Expression Improves Hepatic Steatosis and Hyperlipidemia in Obese Mice" Hepatology (2005) 42:362-371.
Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J Org. Chem. (2009)74: 118-134.
European Supplementary Search Report for Application No. EP 04779444.1 dated Jul. 4, 2008.
European Search Report for application EP 10175722.7 dated Mar. 23, 2011.
Partial Search Report for EP 16824926.6 dated Dec. 3, 2018.
International Search Report for Int. Application No. PCT/US04/24384 dated Mar. 23, 2006.
International Search Report for Int. Application No. PCT/US16/41410 dated Dec. 15, 2016.

MODULATORS OF DIACYGLYCEROL ACYLTRANSFERASE 2 (DGAT2)

SEQUENCE LISTING

The present application is being filed along with a Sequence Listing in electronic format. The Sequence Listing is provided as a file entitled BIOL0178USC1SEQ_ST25.txt created Jun. 28, 2019, which is 1 mb in size. The information in the electronic format of the sequence listing is incorporated herein by reference in its entirety.

FIELD

The present embodiments provide methods, compounds, and compositions for treating, preventing, or ameliorating a disease associated with nonalcoholic fatty liver disease, including non-alcoholic steatohepatitis (NASH) and hepatic steatosis, by administering a diacylglycerol acyltransferase 2 (DGAT2) specific inhibitor to an individual.

BACKGROUND

Nonalcoholic fatty liver diseases (NAFLDs) including NASH (nonalcoholic steatohepatitis) are considered to be hepatic manifestations of the metabolic syndrome (Marchesini G, et al. Hepatology 2003; 37: 917-923) and are characterized by the accumulation of triglycerides in the liver of patients without a history of excessive alcohol consumption. The majority of patients with NAFLD are obese or morbidly obese and have accompanying insulin resistance (Byrne C D and Targher G. J Hepatol 2015 April; 62(1S): S47-S64). The incidence of NAFLD/NASH has been rapidly increasing worldwide consistent with the increased prevalence of obesity, and is currently the most common chronic liver disease. Recently, the incidence of NAFLD and NASH was reported to be 46% and 12%, respectively, in a largely middle-aged population (Williams C D, et al. Gastroenterology 2011; 140: 124-131).

NAFLD is classified into simple steatosis, in which only hepatic steatosis is observed, and NASH, in which intralobular inflammation and ballooning degeneration of hepatocytes is observed along with hepatic steatosis. The proportion of patients with NAFLD who have NASH is still not clear but might range from 20-40%. NASH is a progressive disease and may lead to liver cirrhosis and hepatocellular carcinoma (Farrell G C and Larter C Z. Hepatology 2006; 43: S99-S112; Cohen J C, et al. Science 2011; 332: 1519-1523). Twenty percent of NASH patients are reported to develop cirrhosis, and 30-40% of patients with NASH cirrhosis experience liver-related death (McCullough A J. J Clin Gastroenterol 2006; 40 Suppl 1: S17-S29). Recently, NASH has become the third most common indication for liver transplantation in the United States (Charlton M R, et al. Gastroenterology 2011; 141: 1249-1253).

Currently, the principal treatment for NAFLD/NASH is lifestyle modification by diet and exercise. However, pharmacological therapy is indispensable because obese patients with NAFLD often have difficulty maintaining improved lifestyles.

Lipodystrophy syndromes are a group of rare metabolic diseases characterized by selective loss of adipose tissue that leads to ectopic fat deposition in liver and muscle and the development of insulin resistance, diabetes, dyslipidemia and fatty liver disease (Shulman G I. N Engl J Med 2014; 371: 1131-1141; Garg A. J Clin Endocrinol Metab 2011; 96: 3313-3325; Chan J L and Oral E A. Endocr Pract 2010; 16: 310-323; Garg A. N Engl J Med 2004; 350: 1220-1234). These syndromes constitute a significant medical unmet need as these patients are refractory to current therapies, mainly used to treat diabetes and elevated TG levels, in an attempt to reduce the risk of serious associated complications (coronary artery disease, diabetic nephropathy, cirrhosis and pancreatitis).

Partial Lipodystrophy has a higher prevalence (estimated ~2-3 in one (1) million) than generalized lipodystrophy, but the extent of the prevalence is unknown because these patients are greatly under-diagnosed (Chan J L and Oral E A. Endocr Pract 2010; 16: 310-323; Garg A. J Clin Endocrinol Metab 2011; 96: 3313-3325). Partial lipodystrophy is further divided into acquired partial lipdystrophy (APL) or Familial partial lipodystrophy (FPL). The diagnosis of PL is mainly clinical and needs to be considered in patients presenting with the triad of insulin resistance (with or without overt diabetes), significant dyslipidemia in the form of hypertriglyceridemia, and fatty liver (Huang-Doran I, et al. J Endocrinol 2010; 207: 245-255). Patients often present with diabetes and severe insulin resistance requiring high doses of insulin.

Current treatment includes lifestyle modification such as reducing caloric intake and increasing energy expenditure via exercise. Conventional therapies used to treat severe insulin resistance (metformin, thiazolidinediones, GLP-1s, insulin), and/or high TGs (dietary fat restriction, fibrates, fish oils) are not very efficacious in these patients (Chan J L and Oral E A. Endocr Pract 2010; 16: 310-323; Garg A. J Clin Endocrinol Metab 2011). Partial Lipodystrophy is an ultra-orphan indication for which there is a significant unmet medical need. Diabetes, NASH, and/or hypertriglyceridemia associated with this condition can lead to serious complications (Handelsman Y, et al. Endocr Pract 2013; 19: 107-116).

Diacylglycerol O-acyltransferase (DGAT) catalyzes the final step in triglyceride (TG) synthesis by facilitating the linkage of sn-1,2-diacylglycerol (DAG) with an acyl-CoA. There are two isoforms of DGATs (DGAT1 and DGAT2), and studies indicate that both DGAT1 and DGAT2 play important roles in TG synthesis. DGAT1 is most highly expressed in small intestine and white adipose tissue (WAT), whereas DGAT2 is primarily expressed in liver and WAT (Cases S, et al. Proc Natl Acad Sci USA 1998; 95, 13018-13023; Cases S, et al. J Biol Chem 2001; 276, 38870-38876). Although both DGAT1 and DGAT2 catalyze the same reactions in TG synthesis with DAG or monoacylglycerol (MAG) and acyl-CoA as substrates, they are functionally distinguished not only by their tissue expression, but by their differences in catalytic properties (Cao J, et al. J Lipid Res 2007; 48: 583-591; Cheng D, et al. J Biol Chem 2008; 283: 29802-29811), subcellular localization (Stone S J, et al. J Biol Chem 2004; 279: 11767-11776), and physiological regulation (Meegalla R L, et al. Biochem Biophys Res Commun 2002, 298, 317-323). For example, suppression of DGAT2, but not of DGAT1, by antisense oligonucleotide treatment improved hepatic steatosis and blood lipid levels independent of adiposity in rodent models of obesity and the data indicated that these effects were related to decreased hepatic lipid synthesis (Yu X X, et al. Hepatology 2005; 42: 362-371).

These studies demonstrate that DGAT2 inhibition may improve NAFLD/NASH, as well as the metabolic profile of patients with lipodystrophy syndromes by reducing triglycerides, improving insulin sensitivity, and decreasing hepatic steatosis.

SUMMARY

The present embodiments provided herein are directed to potent and/or tolerable compounds and compositions useful for treating, preventing, ameliorating, or slowing progression of NAFLD, such as NASH, as well as lipodystrophy syndromes, such as partial lipodystrophy.

Several embodiments provided herein are directed to several antisense compounds that are more potent and efficacious than antisense oligonucleotides from an earlier published application, WO 2005/019418. Several embodiments provided herein are directed to compounds and compositions that are potent and tolerable.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, treatises, and GenBank and NCBI reference sequence records are hereby expressly incorporated by reference for the portions of the document discussed herein, as well as in their entirety.

It is understood that the sequence set forth in each SEQ ID NO in the examples contained herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by ISIS number (ISIS #) indicate a combination of nucleobase sequence, chemical modification, and motif.

Unless otherwise indicated, the following terms have the following meanings:

"2'-deoxynucleoside" means a nucleoside comprising 2'-H(H) furanosyl sugar moiety, as found in naturally occurring deoxyribonucleic acids (DNA). In certain embodiments, a 2'-deoxynucleoside may comprise a modified nucleobase or may comprise an RNA nucleobase (e.g., uracil).

"2'-O-methoxyethyl" (also 2'-MOE and 2'-O(CH$_2$)$_2$—OCH$_3$) refers to an O-methoxy-ethyl modification at the 2' position of a sugar ring, e.g. a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" or "2-modified nucleoside" means a nucleoside comprising a 2'-substituted or 2'-modified sugar moiety. As used herein, "2'-substituted" or "2-modified" in reference to a sugar moiety means a furanosyl sugar moiety comprising a 2'-substituent group other than H or OH.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±10% of a value. For example, if it is stated, "the compounds affected at least about 70% inhibition of DGAT2", it is implied that DGAT2 levels are inhibited within a range of 60% and 80%.

"Administration" or "administering" refers to routes of introducing a compound or composition provided herein to an individual to perform its intended function. An example of a route of administration that can be used includes, but is not limited to parenteral administration, such as subcutaneous, intravenous, or intramuscular injection or infusion.

"Administered concomitantly" or "co-administration" means administration of two or more compounds in any manner in which the pharmacological effects of both are manifest in the patient. Concomitant administration does not require that both agents be administered in a single pharmaceutical composition, in the same dosage form, by the same route of administration, or at the same time. The effects of both agents need not manifest themselves at the same time. The effects need only be overlapping for a period of time and need not be coextensive. Concomitant administration or co-administration encompasses administration in parallel or sequentially.

"Amelioration" refers to a lessening of at least one indicator, sign, or symptom of an associated disease, disorder, or condition. In certain embodiments, amelioration includes a delay or slowing in the progression of one or more indicators of a condition or disease. The severity of indicators may be determined by subjective or objective measures, which are known to those skilled in the art.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound to the target.

"Antisense compound" means a compound comprising an antisense oligonucleotide and optionally one or more additional features, such as a conjugate group or terminal group. Examples of antisense compounds include single-stranded and double-stranded compounds. Examples are antisense oligonucleotides, ribozymes, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means an oligonucleotide having a nucleobase sequence that is complementary to a target nucleic acid or a region or segment thereof. In certain embodiments, an antisense oligonucleotide is specifically hybridizable to a target nucleic acid or a region or segment thereof.

"Bicyclic nucleoside" or "BNA" means a nucleoside comprising a bicyclic sugar moiety. As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

"Branching group" means a group of atoms having at least 3 positions that are capable of forming covalent linkages to at least 3 groups. In certain embodiments, a branching group provides a plurality of reactive sites for connecting tethered ligands to an oligonucleotide via a conjugate linker and/or a cleavable moiety.

"Cell-targeting moiety" means a conjugate group or portion of a conjugate group that is capable of binding to a particular cell type or particular cell types.

"Cleavable moiety" means a bond or group of atoms that is cleaved under physiological conditions, for example, inside a cell, an animal, or a human.

"cEt" or "constrained ethyl" means a bicyclic sugar moiety comprising a bridge connecting the 4'-carbon and the 2'-carbon, wherein the bridge has the formula: 4'-CH(CH$_3$)—O-2'.

"Chemical modification" means a chemical difference in a compound when compared to a naturally occurring counterpart. Chemical modifications of oligonucleotides include nucleoside modifications (including sugar moiety modifications and nucleobase modifications) and internucleoside linkage modifications. In reference to an oligonucleotide, chemical modification does not include differences only in nucleobase sequence.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Cleavable bond" means any chemical bond capable of being split. In certain embodiments, a cleavable bond is selected from among: an amide, a polyamide, an ester, an ether, one or both esters of a phosphodiester, a phosphate ester, a carbamate, a di-sulfide, or a peptide.

"Cleavable moiety" means a bond or group of atoms that is cleaved under physiological conditions, for example, inside a cell, an animal, or a human.

"Complementary" in reference to an oligonucleotide means the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. By contrast, "fully complementary" or "100% complementary" in reference to oligonucleotides means that such oligonucleotides have nucleobase matches at each nucleoside without any nucleobase mismatches.

"Conjugate group" means a group of atoms that is directly or indirectly attached to a parent compound, e.g., an oligonucleotide.

"Conjugate linker" means a group of atoms that connects a conjugate group to a parent compound, e.g., an oligonucleotide.

"Constrained ethyl nucleoside" (also cEt nucleoside) means a nucleoside comprising a bicyclic sugar moiety comprising a 4'-CH(CH$_3$)—O-2' bridge.

"Contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other.

"Designing" or "Designed to" refer to the process of designing an oligomeric compound that specifically hybridizes with a selected nucleic acid molecule.

"DGAT2" means any nucleic acid or protein of DGAT2. "DGAT2 nucleic acid" means any nucleic acid encoding DGAT2. For example, in certain embodiments, a DGAT2 nucleic acid includes a DNA sequence encoding DGAT2, an RNA sequence transcribed from DNA encoding DGAT2 (including genomic DNA comprising introns and exons), including a non-protein encoding (i.e. non-coding) RNA sequence, and an mRNA sequence encoding DGAT2. "DGAT2 mRNA" means an mRNA encoding a DGAT2 protein.

"DGAT2 specific inhibitor" refers to any agent capable of specifically inhibiting DGAT2 RNA and/or DGAT2 protein expression or activity at the molecular level. For example, DGAT2 specific inhibitors include nucleic acids (including antisense compounds), peptides, antibodies, small molecules, and other agents capable of inhibiting the expression of DGAT2 RNA and/or DGAT2 protein.

"Dose" means a specified quantity of a pharmaceutical agent provided in a single administration, or in a specified time period. In certain embodiments, a dose may be administered in two or more boluses, tablets, or injections. For example, in certain embodiments, where subcutaneous administration is desired, the desired dose may require a volume not easily accommodated by a single injection. In such embodiments, two or more injections may be used to achieve the desired dose. In certain embodiments, a dose may be administered in two or more injections to minimize injection site reaction in an individual. In other embodiments, the pharmaceutical agent is administered by infusion over an extended period of time or continuously. Doses may be stated as the amount of pharmaceutical agent per hour, day, week or month.

"Dosing regimen" is a combination of doses designed to achieve one or more desired effects.

"Double-stranded antisense compound" means an antisense compound comprising two oligomeric compounds that are complementary to each other and form a duplex, and wherein one of the two said oligomeric compounds comprises an antisense oligonucleotide.

"Effective amount" means the amount of compound sufficient to effectuate a desired physiological outcome in an individual in need of the agent. The effective amount may vary among individuals depending on the health and physical condition of the individual to be treated, the taxonomic group of the individuals to be treated, the formulation of the composition, assessment of the individual's medical condition, and other relevant factors.

"Efficacy" means the ability to produce a desired effect.

"Expression" includes all the functions by which a gene's coded information is converted into structures present and operating in a cell. Such structures include, but are not limited to the products of transcription and translation.

"Fully modified" in reference to an oligonucleotide means a modified oligonucleotide in which each nucleoside is modified. "Uniformly modified" in reference to an oligonucleotide means a fully modified oligonucleotide in which at least one modification of each nucleoside is the same. For example, the nucleosides of a uniformly modified oligonucleotide can each have a 2'-MOE modification but different nucleobase modifications, and the internucleoside linkages may be different.

"Gapmer" means a chimeric antisense compound in which an internal region having a plurality of nucleosides that is positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." In certain embodiments, the structure of a gapmer may support RNase H cleavage.

"Hybridization" means the pairing or annealing of complementary oligonucleotides and/or nucleic acid molecules. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

"Identifying an animal having, or at risk for having, a disease, disorder and/or condition" means identifying an animal having been diagnosed with the disease, disorder and/or condition or identifying an animal predisposed to develop the disease, disorder and/or condition. Such identification may be accomplished by any method including evaluating an individual's medical history and standard clinical tests or assessments.

"Immediately adjacent" means there are no intervening elements between the immediately adjacent elements of the same kind (e.g. no intervening nucleobases between adjacent nucleobases).

"Individual" means a human or non-human animal selected for treatment or therapy.

"Inhibiting the expression or activity" refers to a reduction, blockade of the expression or activity relative to the expression or activity in an untreated or control sample, and does not necessarily indicate a total elimination of expression or activity.

"Internucleoside linkage" means a group or bond that forms a covalent linkage between adjacent nucleosides in an oligonucleotide. As used herein "modified internucleoside linkage" means any internucleoside linkage other than a naturally occurring, phosphate internucleoside linkage. Naturally occurring, non-phosphate linkages are referred to herein as modified internucleoside linkages.

"Phosphorothioate linkage" means a linkage between nucleosides wherein the phosphodiester bond of a phosphate linkage is modified by replacing one of the non-bridging oxygen atoms with a sulfur atom. A phosphorothioate linkage is a modified internucleoside linkage.

"Lengthened" antisense oligonucleotides are those that have one or more additional nucleosides relative to an antisense oligonucleotide disclosed herein; e.g. a parent oligonucleotide.

"Linearly modified sugar" or "linearly modified sugar moiety" means a modified sugar moiety that comprises an acyclic or non-bridging modification. Such linear modifications are distinct from bicyclic sugar modifications.

"Linked deoxynucleoside" means a nucleic acid base (A, G, C, T, U) substituted by deoxyribose linked by a phosphate ester to form a nucleotide.

"Linked nucleosides" are nucleosides that are connected in a continuous sequence (i.e. no additional nucleosides are present between those that are linked).

As used herein, "mismatch" or "non-complementary" means a nucleobase of a first oligonucleotide that is not complementary to the corresponding nucleobase of a second oligonucleotide or target nucleic acid when the first and second oligonucleotides are aligned. For example, a universal nucleobase, inosine, and hypoxanthine, are capable of hybridizing with at least one nucleobase but are still mismatched or non-complementary with respect to nucleobase to which it hybridized. As another example, a nucleobase of a first oligonucleotide that is not capable of hybridizing to the corresponding nucleobase of a second oligonucleotide or target nucleic acid when the first and second oligonucleotides are aligned is a mismatch or non-complementary nucleobase.

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U). A "universal base" is a nucleobase that can pair with any one of the five unmodified nucleobases.

"Modified nucleoside" means a nucleoside having, independently, a modified sugar moiety and/or modified nucleobase.

"Modified nucleotide" means a nucleotide having, independently, a modified sugar moiety, modified internucleoside linkage, or modified nucleobase.

"Modified oligonucleotide" means an oligonucleotide comprising at least one modified internucleoside linkage, a modified sugar, and/or a modified nucleobase.

"Modulating" refers to changing or adjusting a feature in a cell, tissue, organ or organism. For example, modulating DGAT2 RNA can mean to increase or decrease the level of DGAT2 RNA and/or DGAT2 protein in a cell, tissue, organ or organism. A "modulator" effects the change in the cell, tissue, organ or organism. For example, a DGAT2 antisense compound can be a modulator that decreases the amount of DGAT2 RNA and/or DGAT2 protein in a cell, tissue, organ or organism.

"Monomer" refers to a single unit of an oligomer. Monomers include, but are not limited to, nucleosides and nucleotides, whether naturally occurring or modified.

"Motif" means the pattern of unmodified and/or modified sugar moieties, nucleobases, and/or internucleoside linkages, in an oligonucleotide.

"Natural" or "Naturally occurring" means found in nature. "Naturally occurring internucleoside linkage" means a 3' to 5' phosphodiester linkage. "Natural sugar moiety" means a sugar moiety found in DNA (2'-H) or RNA (2'-OH). "Naturally occurring nucleobase" means the purine bases adenine (A) and guanine (G), and the pyrimidine bases thymine (T), cytosine (C) and uracil (U). "Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, and double-stranded nucleic acids.

"Nucleobase" means a heterocyclic moiety capable of pairing with a base of another nucleic acid.

"Nucleobase sequence" means the order of contiguous nucleobases independent of any sugar, linkage, and/or nucleobase modification.

"Nucleoside" means a compound comprising a nucleobase and a sugar moiety. The nucleobase and sugar moiety are each, independently, unmodified or modified.

"Nucleotide" means a nucleoside having a phosphate group covalently linked to the sugar portion of the nucleoside.

"Oligomeric compound" means a compound comprising an oligonucleotide and optionally one or more additional features, such as a conjugate group or terminal group. Examples of oligomeric compounds include single-stranded and double-stranded compounds, such as, antisense compounds, antisense oligonucleotides, ribozymes, siRNAs, shRNAs, ssRNAs, and occupancy-based compounds.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Parent oligonucleotide" means an oligonucleotide whose sequence is used as the basis of design for more oligonucleotides of similar sequence but with different lengths, motifs, and chemistries. The newly designed oligonucleotides may have the same or overlapping sequence as the parent oligonucleotide.

"Parenteral administration" means administration through injection or infusion. Parenteral administration includes subcutaneous administration, intravenous administration, intramuscular administration, intraarterial administration, intraperitoneal administration, or intracranial administration, e.g. intrathecal or intracerebroventricular administration.

"Pharmaceutically acceptable carrier or diluent" means a medium or diluent suitable for use in administering to an animal. For example, a pharmaceutically acceptable carrier can be a sterile aqueous solution, such as PBS or water-for-injection.

"Pharmaceutically acceptable salts" means physiologically and pharmaceutically acceptable salts of compounds, such as oligomeric compounds or antisense compounds, i.e., salts that retain the desired biological activity of the parent compound and do not impart undesired toxicological effects thereto.

"Pharmaceutical agent" means a compound that provides a therapeutic benefit when administered to an individual.

"Pharmaceutical composition" means a mixture of compounds suitable for administering to an individual. For example, a pharmaceutical composition may comprise one or more compounds or salts thereof and a sterile aqueous solution.

"Phosphorothioate linkage" means a modified internucleoside linkage between nucleosides where the phosphodiester bond is modified by replacing one of the non-bridging oxygen atoms with a sulfur atom.

"Phosphorus moiety" means a group of atoms comprising a phosphorus atom. In certain embodiments, a phosphorus moiety comprises a mono-, di-, or tri-phosphate, or phosphorothioate.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an oligomeric compound "Prevent" refers to delaying or forestalling the onset, development or progression of a disease, disorder, or condition for a period of time from minutes to indefinitely. Prevent may also mean reducing the risk of developing a disease, disorder, or condition.

"Prodrug" means a form of a compound which, when administered to an individual, is metabolized to another form. In certain embodiments, the metabolized form is the active, or more active, form of the compound (e.g., drug).

"Prophylactically effective amount" refers to an amount of a pharmaceutical agent that provides a prophylactic or preventative benefit to an animal.

"RefSeq No." is a unique combination of letters and numbers assigned to a sequence to indicate the sequence is for a particular target transcript (e.g., target gene). Such sequence and information about the target gene (collectively, the gene record) can be found in a genetic sequence database. Genetic sequence databases include the NCBI Reference Sequence database, GenBank, the European Nucleotide Archive, and the DNA Data Bank of Japan (the latter three forming the International Nucleotide Sequence Database Collaboration or INSDC).

"Region" is defined as a portion of the target nucleic acid having at least one identifiable structure, function, or characteristic.

"Ribonucleotide" means a nucleotide having a hydroxy at the 2' position of the sugar portion of the nucleotide.

"RNAi compound" means an oligomeric compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. The term RNAi compound excludes antisense oligonucleotides that act through RNase H.

"Segment" is defined as a smaller or sub-portion of region within an antisense compound, an oligonucleotide, or a target nucleic acid.

"Side effects" means physiological disease and/or conditions attributable to a treatment other than the desired effects. In certain embodiments, side effects include injection site reactions, liver function test abnormalities, renal function abnormalities, liver toxicity, renal toxicity, central nervous system abnormalities, myopathies, and malaise. For example, increased aminotransferase levels in serum may indicate liver toxicity or liver function abnormality. For example, increased bilirubin may indicate liver toxicity or liver function abnormality.

"Single-stranded" in reference to an antisense compound or oligomeric compound means there is one oligonucleotide in the compound. "Self-complementary" in reference to an antisense compound or oligomeric compound means a compound that at least partially hybridizes to itself. A compound consisting of one antisense or oligomeric compound, wherein the oligonucleotide of the compound is self-complementary, is a single-stranded compound. A single-stranded antisense or oligomeric compound may be capable of binding to a complementary compound to form a duplex.

"Sites," as used herein, are defined as unique nucleobase positions within a target nucleic acid.

"Slows progression" means decrease in the development of the said disease.

"Specifically hybridizable" refers to an antisense compound having a sufficient degree of complementarity between an antisense oligonucleotide and a target nucleic acid to induce a desired effect, while exhibiting minimal or no effects on non-target nucleic acids.

"Specifically inhibit" a target nucleic acid means to reduce or block expression of the target nucleic acid while exhibiting fewer, minimal, or no effects on non-target nucleic acids reduction and does not necessarily indicate a total elimination of the target nucleic acid's expression.

"Sugar moiety" means a group of atoms that can link a nucleobase to another group, such as an internucleoside linkage, conjugate group, or terminal group. In certain embodiments, a sugar moiety is attached to a nucleobase to form a nucleoside. As used herein, "unmodified sugar moiety" or "unmodified sugar" means a 2'-OH(H) furanosyl moiety, as found in RNA, or a 2'-H(H) moiety, as found in DNA. Unmodified sugar moieties have one hydrogen at each of the 1', 3', and 4' positions, an oxygen at the 3' position, and two hydrogens at the 5' position. As used herein, "modified sugar moiety" or "modified sugar" means a furanosyl moiety comprising a non-hydrogen substituent in place of at least one hydrogen of an unmodified sugar moiety, or a sugar surrogate. In certain embodiments, a modified sugar moiety is a 2'-substituted sugar moiety. Such modified sugar moieties include bicyclic sugars and linearly modified sugars.

"Sugar surrogate" means a modified sugar moiety having other than a furanosyl moiety that can link a nucleobase to another group, such as an internucleoside linkage, conjugate group, or terminal group. Modified nucleosides comprising sugar surrogates can be incorporated into one or more positions within an oligonucleotide. In certain embodiments, such oligonucleotides are capable of hybridizing to complementary oligomeric compounds or nucleic acids.

"Synergy" or "synergize" refers to an effect of a combination that is greater than additive of the effects of each component alone.

"Target gene" refers to a gene encoding a target.

"Target nucleic acid," "target RNA," "target RNA transcript" and "nucleic acid target" mean a nucleic acid capable of being targeted by antisense compounds.

"Targeting" means the process of design and selection of an antisense compound that will specifically hybridize to a target nucleic acid and induce a desired effect.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"Terminal group" means a chemical group or group of atoms that is covalently linked to a terminus of an oligonucleotide.

"Therapeutically effective amount" means an amount of a compound, pharmaceutical agent, or composition that provides a therapeutic benefit to an individual.

"Treat" refers to administering a compound or pharmaceutical composition to an animal in order to effect an alteration or improvement of a disease, disorder, or condition in the animal.

"Unmodified" nucleobases mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleotides) or a DNA nucleotide (i.e. β-D-deoxyribonucleotide).

CERTAIN EMBODIMENTS

Certain embodiments provide methods, compounds and compositions for inhibiting DGAT2 (DGAT2) expression.

Certain embodiments provide antisense compounds targeted to a DGAT2 nucleic acid. In certain embodiments, the DGAT2 nucleic acid has the sequence set forth in RefSeq No. NM_032564.3 (incorporated by reference, disclosed herein as SEQ ID NO: 1) or nucleotides 5669186 to 5712008 of RefSeq No. NT_033927.5 (incorporated by reference, disclosed herein as SEQ ID NO: 2). In certain embodiments, the antisense compound is a single-stranded oligonucleotide.

Certain embodiments provide an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the antisense compound is a single-stranded oligonucleotide.

Certain embodiments provide an antisense compound comprising a modified oligonucleotide consisting of 10 to 30 linked nucleosides and having a nucleobase sequence comprising at least 9, at least 10, at least 11, or at least 12 contiguous nucleobases of any of the nucleobase sequences of SEQ ID NOs: 16-4679. In certain embodiments, the antisense compound is a single-stranded oligonucleotide.

Certain embodiments provide an antisense compound comprising a modified oligonucleotide consisting of 10 to 30 linked nucleosides and having a nucleobase sequence comprising the nucleobase sequence of any one of SEQ ID NOs: 16-4679. In certain embodiments, the antisense compound is a single-stranded oligonucleotide.

Certain embodiments provide an antisense compound comprising a modified oligonucleotide consisting of the nucleobase sequence of any one of SEQ ID NOs: 16-4679. In certain embodiments, the antisense compound is a single-stranded oligonucleotide.

In certain embodiments, antisense compounds or antisense oligonucleotides target the 26711-26802 of a DGAT2 nucleic acid. In certain aspects, antisense compounds or antisense oligonucleotides target within nucleotides 26711-26802 of a DGAT2 nucleic acid having the nucleobase sequence of SEQ ID NO: 2 (nucleotides 5669186 to 5712008 of RefSeq No. NT_033927.5). In certain aspects, antisense compounds or antisense oligonucleotides have at least an 8, 9, 10, 11, 12, 13, 14, 15, or 16 contiguous nucleobase portion complementary to an equal length portion within nucleotides 26711-26802 of a DGAT2 nucleic acid having the nucleobase sequence of SEQ ID NO: 2 (nucleotides 5669186 to 5712008 of RefSeq No. NT_033927.5).

In certain embodiments, antisense compounds or antisense oligonucleotides target a region of a DGAT2 nucleic acid having the nucleobase sequence of SEQ ID NO: 2 within nucleobases 26711-26799, 26711-26730, 26721-26740, 26755-26744, 26778-26797, 26779-26798, 26755-26798, and 26780-26799. In certain aspects, antisense compounds or antisense oligonucleotides target at least an 8, 9, 10, 11, 12, 13, 14, 15, or 16 contiguous nucleobases within the aforementioned nucleobase regions.

In certain embodiments, the following nucleotide regions of SEQ ID NO: 2, when targeted by antisense compounds or oligonucleotides, display at least 60% inhibition: 9930-9949, 9953-9973, 9959-9978, 9961-9981, 9970-9992, 9975-9994, 9984-10003, 10040-10059, 10043-10063, 10045-10064, 10046-10065, 10049-10068, 10054-10073, 10160-10179, 10209-10229, 10212-10231, 10214-10235, 10217-10236, 10218-10238, 10327-10346, 10389-10413, 10490-10511, 10522-10548, 10530-10549, 10531-10551, 10533-10553, 10645-10669, 10651-10670, 10653-10673, 10655-10674, 10656-10675, 10657-10676, 10658-10680, 10662-10681, 10663-10684, 10666-10685, 10667-10684, 10670-10689, 10702-10721, 10727-10747, 10729-10748, 10730-10750, 10733-10755, 10737-10756, 10742-10761, 10763-10782, 10814-10835, 10817-10836, 10818-10837, 10940-10964, 11008-11027, 11074-11097, 11123-11150, 11158-11182, 11168-11187, 11170-11190, 11171-11197, 11199-11218, 11200-11220, 11209-11228, 11318-11342, 11413-11432, 11559-11578, 11594-11618, 11707-11731, 11872-11891, 11920-11939, 12247-12266, 12285-12304, 12549-12573, 12671-12695, 12806-12826, 12839-12863, 12890-12909, 12927-12961, 13098-13117, 13212-13231, 13239-13258, 13441-13461, 13921-13945, 13962-13996, 14177-14201, 14194-14218, 14239-14258, 14385-14404, 14457-14522, 14504-14527, 14537-14556, 14648-14697, 14715-14790, 14715-14739, 14735-14764, 14746-14765, 14749-14774, 14756-14779, 14765-14789, 14771-14790, 14807-14831, 14852-14871, 14882-14901, 14953-15015, 14997-15065, 15041-15107, 15041-15092, 15083-15107, 15178-15197, 15214-15243, 15219-15243, 15248-15276, 15255-15276, 15292-15311, 15318-15338, 15321-15342, 15353-15372, 15368-15392, 15514-15533, 15573-15665, 15573-15597, 15729-15753, 15804-15828, 15814-15833, 15876-15900, 15876-15896, 15933-15962, 15933-15954, 15991-16010, 16046-16073, 16082-16124, 16237-16256, 16288-16314, 16288-16478, 16308-16329, 16428-16478, 16510-16529, 16808-16855, 16808-16828, 16811-16855, 16898-16921, 17007-17031, 17038-17057, 17207-17229, 17269-17298, 17273-17294, 17328-17357, 17420-17444, 17450-17471, 17530-17559, 17328-17559, 17960-17989, 18078-18097, 18155-18176, 18155-18198, 18177-18200, 18225-18305, 18306-18327, 18309-18330, 18312-18330, 18312-18332, 18315-18344, 18329-18355, 18379-18398, 18417-18446, 18430-18451, 1818450-18473, 18470-18494, 18581-18601, 18583-18605, 18581-18611, 18588-18611, 18821-18850, 18821-18847, 18836-18899, 18890-18914, 18898-18919, 19013-19037, 19013-19040, 19360-19411, 19363-19383, 19804-19823, 19909-19932, 19987-20009, 20232-20256, 20296-20325, 20462-20481, 20541-20560, 20668-20692, 20775-20797, 20779-20797, 20817-20841, 20828-20863, 20878-20897, 20956-20979, 21046-21120, 21091-21120, 21164-21203, 21164-21188, 21374-21403, 21659-21678, 21708-21727, 21765-21784, 21933-21955, 22153-22191, 22153-22175, 22158-22179, 22167-22191, 22439-22463, 22547-22567, 22770-22790, 22770-22795, 22775-22795, 22835-22870, 22841-22865, 22881-22901, 22885-22905, 22889-22910, 23095-23115, 23098-23119, 23099-23119, 23128-23157, 23179-23251, 23238-23258, 23240-23260, 23242-23262, 23429-23449, 23480-23566, 23547-23581, 23553-23573, 23555-23576, 23562-23586, 23597-23616, 23641-23670, 24123-24144, 24123-24147, 24202-24223, 24202-24241, 24799-25039, 24799-24847, 25018-2509, 25023-25053, 25026-25053, 25069-25092, 25069-25114, 25077-25104, 25088-25114, 25183-25205, 25183-25217, 25198-25217, 25226-25250, 25226-25265, 25236-25260, 25244-25291, 25312-25394, 25380-25400, 25717-25736, 25782-25860, 25845-25866, 25866-25935, 25919-25939, 25950-25971, 25954-25973, 25981-26030, 26102-26126, 26162-26220, 26300-26324, 26331-26372, 26363-26405, 26389-26409, 26396-26420, 26479-26504, 26516-26550, 26534-26555, 26534-26560, 26540-26560, 26610-26634, 26620-26640, 26626-26648, 26620-26664, 26633-26655, 26640-26664, 26716-26740, 26716-26799, 26755-26799, 26786-26807, 26789-26809, 26786-26809, 26811-26831, 26849-26869, 26869-26898, 26883-26903, 26926-26943, 27046-27075, 27106-27130, 27174-27230, 27221-27241, 27226-27258, 27241-27265, 27249-27269, 27367-27406, 27367-27402, 27386-27406, 27638-27664, 27769-27791, 27775-27810, 27852-27877, 28026-28049, 28128-28154, 28462-28492, 28475-28508, 28516-28542, 28584-28605, 28804-28826, 29010-29035, 29143-29167, 29151-29180, 29196-29218, 29244-29268, 29253-29282, 29361-29383, 29369-29391, 29450-29495, 29480-29504, 29538-29654, 29673-29697, 29681-29702, 29781-29801, 29804-29828, 29827-29847, 29832-29852, 29838-29858, 29844-29878, 30484-30504, 30524-30548, 30554-30588, 30669-30731, 30972-30997, 30984-31005, 31551-31571, 31554-31584, 31794-31818, 31932-31952, 31936-31956, 31939-31963, 31946-31971, 32115-32136, 32119-32140, 32130-32159, 32175-32201, 32428-32454, 32436-32467, 32459-32479, 32463-32489, 32474-32495, 32480-32529, 32586-32638, 32621-32641, 32756-32776, 32801-32825, 32816-32840, 33070-33180, 33176-33199, 33182-33202, 33411-33433, 33572-33601, 33729-33759, 33846-33876, 33860-33882, 33866-33886, 34063-34117, 34211-34232, 34686-34710, 34739-34887, 34901-34950, 35263-35292, 35277-35302, 35322-35346, 35408-35433, 35421-35441, 35436-35457, 35665-35685, 36246-36267, 36250-36270, 36253-36274, 36258-36281, 36268-36531, 36516-36537, 36573-36597, 36581-36603, 36632-36666, 36677-36698, 36682-36702, 36689-36757, 36742-36772, 36841-36874, 36846-36874, 36865-37041, 37054-37073, 37838-37858, 39668-39694, 39684-39705, 39820-39840, 39830-39852, and 40909-40933.

In certain embodiments, the following nucleotide regions of SEQ ID NO: 2, when targeted by antisense compounds or oligonucleotides, display at least 70% inhibition: 9971-9991, 9975-9994, 9984-10003, 10040-10059, 10044-10063, 10045-10064, 10049-10068, 10054-10179, 10210-10229, 10214-10234, 10216-10235, 10217-10236, 10218-10237, 10327-10346, 10490-10509, 10491-10511, 10522-10541, 10528-10548, 10530-10549, 10531-10550, 10532-10551, 10533-10553, 10536-10555, 10537-10556, 10645-10664, 10647-10666, 10649-10669, 10653-10673, 10655-10674, 10656-10675, 10657-10676, 10658-10677, 10659-10679, 10661-10680, 10662-10681, 10663-10683, 10665-10684, 10666-10685, 10667-10686, 10668-10687, 10670-10689, 10672-10691, 10702-10721, 10727-10747, 10729-10748, 10730-10750, 10732-10751, 10733-10752, 10734-10753, 10735-10754, 10737-10756, 10742-10756, 10742-10761, 10763-10782, 10815-10835, 10817-10836, 10818-10837, 10819-10840, 10940-10959, 10941-10960, 10942-10961, 10944-10963, 11008-11027, 11074-11093, 11075-11094, 11076-11095, 11078-11097, 11124-11146, 11128-11147, 11129-11148, 11130-11149, 11131-11177, 11159-11178, 11160-11179, 11161-11180, 11168-11187, 11170-11190, 11172-11191, 11173-11192, 11174-11196, 11180-11218, 11200-11219, 11201-11221, 11203-11222, 11204-11220, 11209-11228, 11323-11342, 11413-11432, 11559-11578, 11599-11618, 11872-11891, 112285-12304, 12549-12568, 12806-12826, 12809-12828, 12927-12946, 12942-12961, 13441-13461, 13926-13945, 14182-14201, 14194-14213, 14196-14216, 14239-14258, 14385-14404, 14462-14522, 14504-14523, 14505-14524, 14506-14527, 14537-14556, 14648-14667, 14649-14668, 14650-14669, 14651-14670, 14658-14682, 14664-14683, 14665-14684, 14666-14686, 14668-14687, 14673-14739, 14741-14764, 14746-14765, 14749-14774, 14756-14775, 14757-14779, 14765-14784, 14767-14786, 14769-14789, 14771-14790, 14772-14793, 14807-14831, 14852-15005, 14992-15012, 14995-15015, 14997-15016, 14998-15017, 14999-15020, 15011-15040, 15073-15092, 15214-15233, 15219-15243, 15248-15269, 15248-15276, 15251-15270, 15252-15272, 15254-15273, 15255-15274, 15256-15276, 15321-15342, 15573-15595, 15578-15665, 15729-15748, 15809-15828, 15876-15895, 15881-15952, 15991-16066, 16051-16070, 16053-16102, 16289-16309, 16292-16312, 16310-16329, 16248-16448, 16432-16451, 16438-16457, 16808-16828, 16811-16830, 16813-16832, 16815-16835, 16828-16852, 16836-16855, 16898-16917, 16900-16921, 17007-17027, 17207-17227, 17210-17229, 17274-17294, 17328-17347, 17330-17352, 17450-17549, 17960-17979, 18155-18175, 18157-18176, 18160-15180, 18162-18181, 18163-18182, 18164-18183, 18165-18184, 18166-18185, 18172-18193, 18175-18194, 18176-18194, 18176-18195, 18178-18199, 18181-18200, 18225-18244, 18235-18305, 18307-18327, 18309-18328, 18310-18330, 18312-18332, 18315-18337, 18320-18340, 18322-18341, 18323-18342, 18324-18343, 18325-18347, 18330-18355, 18379-18436, 18418-18437, 18419-18438, 18420-18439, 18422-18441, 18431-18451, 18450-18469, 18451-18470, 18452-18471, 18470-18489, 18581-18600, 18582-18601, 18583-18602, 18584-18604, 18588-18610, 18828-18847, 18829-18848, 18831-18850, 18869-18888, 18870-18889, 18899-18919, 19013-19032, 19016-19035, 19018-19037, 19020-19039, 19360-19380, 19364-19383, 19911-19932, 19987-20008, 20232-20251, 20298-20317, 20300-20325, 20668-20689, 20672-20692, 20775-20796, 20780-20800, 20822-20841, 20829-20851, 20837-20857, 20840-20862, 20958-20979, 21164-21183, 21384-21403, 21933-21952, 22155-22175, 22439-22463, 22548-22567, 22549-22568, 22771-22790, 22772-22791, 22773-22792, 22846-22865, 22886-22905, 22888-22907, 22889-22908, 23095-23115, 23098-23117, 23099-23119, 23128-23147, 23138-23157, 23184-23251, 23238-23258, 23242-23261, 23243-23262, 23244-23263, 23245-23264, 23246-23262, 23305-23324, 23426-23446, 23430-23449, 23551-23570, 23552-23571, 23553-23572, 23554-23573, 23557-23576, 23562-23586, 23641-23665, 24123-24142, 24799-24897, 25019-25038, 25023-25042, 25026-25045, 25028-25092, 25075-25094, 25077-25101, 25085-25104, 25088-25202, 25186-25205, 25193-25212, 25198-25250, 25236-25255, 25245-25291, 25312-25394, 25380-25399, 25429-25448, 25717-25808, 25841-25860, 25846-25865, 25900-25928, 25911-25930, 25913-25935, 25920-25971, 25981-26026, 26010-26030, 26102-26121, 26165-26186, 26169-26219, 26300-26324, 26353-26372, 26358-26377, 26363-26404, 26389-26409, 26397-26416, 26479-26498, 26482-26503, 26516-26535, 26517-26536, 26518-26537, 26519-26538, 26520-26540, 26526-26550, 26535-26555, 26537-26556, 26538-26557, 26539-26558, 26615-26634, 26620-26640, 26626-26646, 26628-26647, 26629-26648, 26630-26649, 26631-26650, 26632-26651, 26633-26652, 26635-26654, 26640-26659, 26711-26730, 26721-26799, 26786-26807, 26811-26830, 26852-26871, 26854-26873, 26869-26898, 26883-26903, 26927-26946, 27050-27075, 27106-27125, 27221-27240, 27228-27247, 27231-27250, 27235-27257, 27241-27265, 27249-27268, 27367-27386, 27377-27396, 27379-27398, 27381-27401, 27383-27402, 27387-27406, 27438-27457, 27639-27658, 27642-27661, 27644-27664, 27769-27790, 27775-27799, 27782-27809, 27853-27877, 28026-28048, 28128-28154, 28463-28484, 28468-28489, 28475-28500, 28516-28542, 28806-28826, 29010-28033, 29140-29159, 29143-29165, 29148-29167, 29154-29177, 29160-29180, 29193-29212, 29196-29218, 29201-29220, 29245-29265, 29253-29272, 29255-29274, 29257-29278, 29262-29282, 26361-29382, 29369-29388, 29371-29390, 29485-29504, 29538-29557, 29548-29594, 29635-29654, 29673-29692, 29675-29695, 29678-29697, 29682-29702, 29781-29801, 29809-29828, 29827-59847, 29829-29848, 29830-29849, 29831-29850, 29832-29852, 29838-29858, 29840-29859, 29842-29861, 29843-29862, 29844-29873, 30483-30502, 30484-30503, 30514-30533, 30529-30548, 30559-30578, 30669-30693, 30972-30992, 30977-30996, 30982-31001, 30986-31005, 31554-31573, 31768-31787, 31797-31817, 31933-31952, 31936-31956, 31942-31961, 32116-32135, 32120-32140, 32131-32151, 32135-32158, 32177-32198, 32182-32201, 32336-32355, 32428-32447, 32429-32448, 32430-32449, 32431-32450, 32432-32451, 32433-32452, 32434-32450, 32435-32454, 32436-32455, 32446-32466, 32449-32468, 32450-32469, 32451-32470, 32452-32471, 32453-32472, 32454-32473, 32455-32474, 32456-32475, 32457-32476, 32459-32479, 32461-32480, 32462-32481, 32463-32483, 32465-32486, 32468-32489, 32475-32495, 32477-32496, 32478-32497, 32480-32500, 32510-32529, 32619-32638, 32621-32640, 32622-32641, 32623-32642, 32645-32664, 32670-32689, 32711-32730, 32752-32771, 32753-32772, 32755-32774, 32756-32776, 32816-32840, 33096-33125, 33161-33180, 33179-33199, 33181-33200, 33182-33201, 33412-33433, 33729-33750, 33861-33881, 33866-33885, 33918-33937, 34017-34036, 34211-34231, 34216-34235, 34350-34369, 34460-34479, 34739-34887, 34901-34950, 35278-35298, 35322-35346, 35362-35381, 35410-35430, 35414-35433, 35421-35440, 35436-35457, 35665-36685, 36246-36267, 36249-36268, 36250-36269, 36251-36270, 36252-36271, 36253-36272, 36258-36277, 36262-36281, 36268-36287, 36354-36428, 36512-36531, 36517-36536, 36573-36597, 36582-36602, 36617-36636, 36677-36698, 36680-36699, 36681-36700, 36682-36702, 36691-36754, 36738-36757, 36743-36772, 36758-36777, 36841-36860, 36846-36865, 36865-36942, 37054-37138, 37389-37408, 37497-37516, 37499-37518, 37501-37520, 37745-37764, 39670-39689, 39685-39704, 39820-39839, 39830-39849, 39832-39852, and 40333-40352.

In certain embodiments, the following nucleotide regions of SEQ ID NO: 2, when targeted by antisense compounds or oligonucleotides, display at least 80% inhibition: 10040-10059, 10044-10063, 10045-10064, 10054-10073, 10210-10229, 10214-10234, 10217-10236, 10490-10509, 10531-10550, 10532-10551, 10533-10552, 10645-10664, 10650-10669, 10655-10674, 10656-10675, 10657-10676, 10659-10678, 10660-10679, 10661-10680, 10663-10682, 10664-10683, 10665-10684, 10666-10685, 10667-10686, 10670-10689, 10727-10746, 10730-10749, 10731-10750, 10732-10751, 10734-10753, 10735-10754, 10737-10756, 10816-10835, 10817-10836, 10818-10837, 10819-10838, 10820-10840, 10940-10959, 10941-10960, 10942-10961, 10944-10963, 11074-11093, 11075-11094, 11127-11146, 11128-11147, 11129-11148, 11130-11149, 11131-11177, 11159-11178, 11160-11179, 11170-11190, 11172-11191, 11173-11192, 11174-11193, 11175-11196, 11178-11197, 11199-

11218, 11200-11219, 11201-11220, 11202-11221, 11203-11222, 11559-11578, 11599-11618, 12285-12304, 13442-13461, 14462-14481, 14503-14522, 14504-14523, 14505-14524, 14506-14527, 14648-14667, 14649-14668, 14650-14669, 14651-14670, 14658-14682, 14664-14683, 14666-14686, 14673-14697, 14741-14760, 14743-14764, 14746-14765, 14750-04769, 14752-14774, 14756-14775, 14757-14775, 14758-14777, 14759-14778, 14769-14789, 14771-14790, 14772-14791, 14773-14792, 14774-14793, 14807-14826, 14882-14901, 14986-15005, 14993-15012, 14995-15015, 14997-15016, 14998-15017, 14999-15018, 15000-15019, 15001-15020, 15016-15035, 15248-15268, 15250-15269, 15251-15270, 15252-15272, 15254-15273, 15319-15338, 15321-15342, 15574-15593, 15646-15665, 15881-15952, 16310-16329, 16813-16832, 16830-16852, 16900-16921, 17007-17026, 17208-17227, 17450-17470, 18156-18175, 18157-18176, 18161-18180, 18164-18183, 18166-18185, 18173-18193, 18175-18194, 18176-18195, 18180-18199, 18308-18327, 18310-18329, 18311-18330, 18312-18331, 18321-18340, 18323-18342, 18324-18343, 18325-18344, 18326-18345, 18327-18346, 18328-18347, 18331-18350, 18379-18436, 18432-18451, 18450-18469, 18581-18600, 18585-18604, 18828-18847, 18829-18848, 18900-18919, 19911-19930, 20300-20321, 20668-20687, 20830-20849, 20837-20857, 20958-20977, 22444-22463, 22548-22567, 22771-22790, 22772-22791, 22773-22792, 22886-22905, 23096-23115, 23100-23119, 23239-23258, 23242-23261, 23243-23262, 23244-23263, 23245-23264, 23246-23262, 23427-23446, 23551-23570, 23552-23571, 23557-23576, 24123-24142, 24878-24897, 25023-25042, 25028-25047, 25033-25088, 25073-25092, 25075-25094, 25078-25101, 25085-25104, 25183-25202, 25193-25212, 25246-25291, 25375-25394, 25380-25399, 25782-25804, 25787-25806, 25841-25860, 25846-25865, 25900-25919, 25905-25928, 25911-25930, 25915-25934, 25950-25970, 26005-26025, 26010-26029, 26162-26185, 26169-26191, 26174-26194, 26179-26219, 26300-26319, 26302-26321, 26304-26324, 26353-26372, 26358-26377, 26482-26501, 26517-26536, 26519-26538, 26520-26539, 26521-26540, 26536-26550, 26537-26556, 26538-26557, 26615-26634, 26620-26639, 26627-26646, 26629-26648, 26630-26649, 26631-26650, 26632-26651, 26635-26654, 26640-26659, 26711-26730, 26778-26798, 26788-26807, 26811-26830, 26884-26903, 27050-27070, 27053-27072, 27055-27075, 27221-27240, 27231-27250, 27236-27256, 27241-27260, 27382-27401, 27383-27402, 27387-27406, 27770-27789, 27775-27794, 27777-27796, 27779-27799, 27782-27804, 27787-27809, 27853-27877, 28026-28046, 28029-28048, 28128-28149, 28133-28152, 28463-28482, 28468-28488, 28476-28497, 28480-28500, 29011-29030, 29143-29163, 29160-29179, 29193-29212, 29245-29265, 26253-26272, 29369-29388, 29548-29589, 29678-29697, 29683-29702, 29782-29801, 29827-29847, 29829-29848, 29830-29849, 29838-29858, 29840-29859, 29841-29860, 29842-29861, 29844-29863, 29854-29873, 30483-30502, 30484-30503, 30529-30548, 30674-30693, 30982-31001, 31554-31573, 32131-32151, 32135-32154, 32182-32201, 32431-32450, 32432-32451, 32433-32452, 32434-32453, 32446-32466, 32448-32467, 32449-32468, 32450-32469, 32451-32470, 32452-32471, 32453-32472, 32454-32473, 32455-32474, 32456-32475, 32459-32479, 32461-32480, 32462-32481, 32463-32482, 32464-32483, 32465-32484, 32466-32485, 32467-32486, 32468-32487, 32469-32488, 32470-32489, 32476-32495, 32477-32496, 32480-32499, 32619-32638, 32620-32639, 32621-32640, 32623-32642, 32645-32664, 32752-32771, 32753-32772, 32757-32776, 32816-32835, 33179-33199, 33181-33200, 33182-33201, 33412-33433, 33729-33749, 33866-33885, 34211-34231, 34739-34758, 34931-34950, 35436-35456, 35666-35685, 36247-36266, 36249-36268, 36250-36269, 36251-36270, 36252-36271, 36253-36272, 36258-36277, 36354-36373, 36409-36428, 36512-36531, 36517-36536, 36583-36602, 36680-36699, 36681-36700, 36841-36860, 36846-36865, 39670-39689, and 39832-39851.

In certain embodiments, the following nucleotide regions of SEQ ID NO: 2, when targeted by antisense compounds or oligonucleotides, display at least 90% inhibition: 32447-32466, 32452-32471, 32460-32479, 32462-32481, 32464-32483, 32465-32484, 32466-32485, 32467-32486, 32468-32487, 32619-32638, 32620-32639, 32753-32772, 36250-36269, 36517-36536, 32432-32451, 32431-32450, 30483-30502, 29828-29847, 29011-29030, 28026-28045, 29011-29030, 29828-29847, 30483-30502, 32431-32450, 32432-32451, 32447-32466, 32452-32471, 32460-32479, 32462-32481, 32464-32483, 32465-32484, 32466-32485, 32467-32486, 32468-32487, 32619-32638, 32620-32639, 32753-32772, 36250-36269, 36252-36271, 36409-36428, and 36517-36536.

In certain embodiments, the following antisense compounds or antisense oligonucleotides target a region of a DGAT2 nucleic acid and effect at least a 60% inhibition of a DGAT2 mRNA, ISIS NOs: 413236, 413284, 413391, 413399, 413413, 413422, 413433, 413433, 413441, 413446, 423460-423466, 423520-423527, 423601-423604, 472182, 472188, 472189, 472194-472196, 472203-472206, 472208, 472347, 472349-472352, 472398, 483803, 483811-483814, 483816-483818, 483821-483823, 483825-483835, 483838-483842, 483846-483848, 483852, 483853, 483862, 483866, 483868-483875, 483879, 483886-483890, 483892, 483895, 483897-483903, 483906-483913, 483916-483929, 483932-483934, 483936, 483942, 483948-483950, 483952, 483954, 483956, 483961, 483968-483973, 483975-483979, 483981, 483983-483989, 483992-483997, 484001, 484002, 484004-484006, 484008-484013, 484015-484017, 484019, 484020, 484028, 484030, 484031, 484041, 484049, 484050, 484054-484057, 484063-484065, 484069-484073, 484081-484083, 484085, 484089, 484094, 484097-484107, 484110, 484111, 484114-484119, 484123, 484125-484127, 484129-484137, 484139-484142, 484145-484149, 484152, 484154, 484156-484159, 484161, 484162, 484164, 484165, 484167-484172, 484178-484182, 484184, 484185, 484188, 484190-484198, 484202-484204, 484209-484211, 484213, 484215, 484217-484221, 484227, 484231, 484232, 484234, 484235, 484237, 484240-484243, 484248-484250, 484257, 484263, 484265-484271, 484273-484276, 484281-484285, 484290, 484292, 484293, 484298, 484299, 484301, 484302, 484310, 484319-484325, 484327, 484336, 484338, 484342-484344, 484346-484357, 484359, 484362-484365, 484368, 484370-484387, 484390, 484404, 484411, 495425, 495428, 495429, 495430, 495436, 495438, 495440-495459, 495461-495473, 495475, 495476, 495479-495492, 495495-495511, 495514-495545, 495548-495580, 495584, 495585, 495587-495594, 495596-495626, 495630-495639, 495641-495644, 495648-495651, 495656, 495657, 495660-495662, 495664-495667, 495669-495671, 495676, 495677, 495684-495689, 495692-495707, 495711, 495713, 495714, 495717-495732, 495734, 495736-495739, 495742-495757, 495762-495766, 495772-495774, 495781-495786, 495788, 495789, 495791, 495793-495797, 495799, 495800, 495804, 495808-495813, 495817-495844, 495847-495860, 495862-495870, 495873-495883, 495886, 495899-495904, 495909, 495911-495914, 495918, 495920-495923, 495955, 495957, 495958, 495983, 495992, 496004, 496009, 496010, 496012, 496033, 500841, 500843, 500844, 500852, 500859, 500866, 500867, 500870, 500871, 500892, 500895, 500912, 500913, 500928, 500929, 500934, 500935, 500942, 500944-500946, 500950, 500953, 500957, 500960, 500961, 500966, 500974, 500975, 500979, 500982, 500985, 500986, 500989, 500990, 500994, 500995, 500997, 500998, 501004, 501007, 501008, 501016, 501018-501020, 501025, 501026, 501029-501031, 501033-501035, 501037-501041, 501043, 501055, 501061, 501062, 501064, 501067-501070, 501076, 501093-501098, 501100, 501103, 501104, 501106, 501108, 501111, 501117-501119, 501122-501130, 501140, 501154, 501155, 501158, 501165, 501171, 501176, 501177, 501182-501184, 501193, 501194, 501199, 501200, 501209, 501210, 501212-501214, 501217, 501224, 501227-501230, 501240, 501241, 501244, 501247-501249, 501254, 501256, 501264, 501270, 501287, 501289, 501290, 501297, 501319, 501322, 501326, 501332, 501335, 501342, 501345, 501353, 501357, 501370, 501382-501406, 501410-501412, 501414, 501426-501431, 501434-501443, 501445-501457, 501831, 501835, 501837, 501838, 501849-501853, 501855, 501861, 501867, 501871, 501880, 501883, 501884, 501886-501890, 501900, 501903, 501916, 501932-501934, 501944, 501946, 501947, 501950, 501951, 501957, 501959, 501960, 501966, 501968, 501976, 501977, 501979, 501981-501983, 501991, 501996, 502011, 502013-502015, 502019, 502024-502028, 502031, 502034, 502036-502042, 502045, 502046, 502050, 502053, 502055, 502056, 502062, 502065, 502068-502070, 502083-502085, 502095-502100, 502102, 502106, 502110, 502113, 502114, 502117, 502119, 502120, 502122, 502124, 502127, 502131, 502135, 502144, 502146, 502149, 502150, 502154-502156, 502158, 502163, 502164, 502167, 502172-502176, 502179, 502186, 502189, 502191, 502192, 502194, 502204, 502206, 502215, 502220, 502223, 502228, 502236, 502314, 502319, 502320, 502322, 502334, 502336, 507663, 507665, 507667, 507669, 507675, 507677, 507679, 507684, 507689-507696, 507705, 507709-507719, 507724, 507726, 522363, 522365, 522366, 522368-522375, 522383-522386, 522389, 522391, 522395, 522396, 522398-522413, 522416-522422, 522424-522440, 522442-522452, 522454, 522456, 522457, 522461-522467, 522469-522474, 522478-522490, 522492-522513, 522516-522518, 522521, 522522, 522525, 522529, 522530, 522533-522535, 522540-522550, 522552-522558, 522561-522565, 522573, 522577-522582, 522586-522593, 522597, 522598, 522602-522614, 522617-522625, 522627-522639, 522642-522645, 522657-522663, 522666-522668, 522671-522684, 522686-522702, 522704-522728, 522732, 522733, 522738-522740, 522744-522749, 522754, 522757-522761, 522763-522771, 522776-522778, 522780, 522782-522785, 522788-522797, 522801-522803, 522805, 522807-522809, 522813, 522821-522824, 522829-522831, 522835-522839, 522842, 522844, 522846-522850, 522852-522854, 522856, 522857, 522865-522873, 522875-522880, 522887-522897-522899, 522901, 522904-522906, 522909, 522913, 522914, 522917, 522924, 522925, 522927, 522931-522935, 522939-522943, 522945-522950, 522956, 522964, 522965, 522970, 522977-522982, 522986, 522987, 522996, 522997, 523000-523002, 523015, 523016, 523022, 523025-523027, 525388, 525391, 525394, 525395, 525399, 525401-525405, 525414-525416, 525419, 525420, 525423, 525424, 525431, 525434-525436, 525441-525444, 525450, 525461, 525468-525474, 525477, 525479, 525480, 525484, 525485, 525488-525491, 525498-525501, 525504-525507, 525511-525518, 525520, 525528, 525535-525537, 525539, 525541, 525542, 525544, 525547-525558, 525565, 525577-525579, 525606, 525609-525612, 525619, 525631, 525632, 525649, 525650, 525658, 525683, 525687, 525688, 525690, 525705-525711, 525733, 525737, 525740, 525741, and 525754.

In certain embodiments, the following antisense compounds or antisense oligonucleotides target a region of a DGAT2 nucleic acid and effect at least a 60% inhibition of a DGAT2 mRNA, SEQ ID NOs: 20, 38, 39, 41, 46-48, 61-64, 68, 69, 74, 75, 76, 103, 120, 121, 122, 131, 134, 144, 145, 150, 152, 153, 154, 181, 182, 183, 202-204, 221, 225, 226, 229, 236, 237, 246, 247, 251, 259, 262, 272, 277-280, 283, 383, 391, 405, 414, 425, 433, 438, 450, 452, 453, 455-479, 482-496, 504-507, 509-511, 514-516, 518-528, 531-535, 539-541, 545, 546, 555, 559, 561-568, 574, 575, 577, 578, 583, 584, 589, 594-596, 597, 601, 607, 608, 613-615, 622-625, 627, 652, 653, 660, 674, 706, 709-711, 718-720, 726, 738, 740-745, 749-752, 754-756, 758-769, 774, 789, 793, 794, 807-812, 815, 819, 820, 839, 841-846, 848-852, 878-880, 884, 885, 889, 890, 892-895, 897, 899, 900, 902, 904, 907, 910, 913-916, 923, 935-940, 960-964, 968, 972-977, 979-981, 983-985, 988, 991-1010, 1014, 1015, 1017, 1018, 1020, 1023-1025, 1032-1034, 1036-1038, 1040, 1043-1049, 1051-1054, 1057-1061, 1065, 1071-1073, 1078-1080, 1083, 1084, 1092-1098, 1103, 1107, 1108, 1117, 1118, 1136, 1141, 1142, 1148, 1149, 1153, 1155, 1159, 1165, 1172-1176, 1178, 1181, 1183-1189, 1192-1199, 1202-1215, 1218-1220, 1222, 1228, 1234-1236, 1238, 1240, 1242, 1247, 1254-1259, 1261-1265, 1267, 1269-1275, 1278-1283, 1287, 1288, 1290-1292, 1294-1299, 1301-1303, 1305, 1306, 1314, 1316, 1317, 1327, 1335, 1336, 1340-1343, 1349-1351, 1355-1359, 1367-1369, 1371, 1375, 1380, 1383-1393, 1396, 1397, 1400-1405, 1409, 1411-1413, 1415-1423, 1425-1428, 1431-1435, 1438, 1440, 1442-1445, 1447, 1448, 1450, 1451, 1453-1458, 1464-1468, 1470, 1471, 1474, 1476-1484, 1488-1490, 1495-1497, 1499, 1501, 1503-1507, 1513, 1517, 1518, 1520, 1521, 1523, 1526-1529, 1534-1536, 1543, 1549, 1551-1557, 1559-1562, 1567-1571, 1576, 1578, 1579, 1584, 1585, 1587, 1588, 1596, 1605-1611, 1613, 1622, 1624, 1628-1630, 1632-1643, 1645, 1648-1651, 1654, 1656-1673, 1676, 1677, 1690, 1697, 1698, 1701-1703, 1709, 1711, 1713-1746, 1748, 1749, 1752-1765, 1768-1784, 1787-1818, 1821-1853, 1857, 1858, 1860-1867, 1869-1899, 1903-1912, 1914-1917, 1921-1924, 1929, 1930, 1933-1935, 1937-1940, 1942-1944, 1949, 1950, 1957-1962, 1965-1980, 1984, 1986, 1987, 1990-2005, 2007, 2009-2012, 2015-2030, 2035-2039, 2045-2047, 2054-2059, 2061, 2062, 2064, 2066-2070, 2072, 2073, 2077, 2081-2086, 2090-2117, 2120-2133, 2135-2143, 2146-2156, 2159, 2172-2177, 2182, 2184-2187, 2191, 2193-2196, 2228, 2230, 2231, 2256, 2265, 2277, 2282, 2283, 2285, 2306, 2308, 2310-2334, 2338-2340, 2342, 2350, 2351, 2354-2359, 2362-2371, 2373-2385, 2402, 2405, 2409, 2415, 2418, 2425, 2428, 2436, 2440, 2453, 2465-2468, 2478, 2479, 2482, 2485-2487, 2492, 2494, 2502, 2508, 2525, 2527, 2528, 2535, 2543, 2544, 2547, 2554, 2560, 2565, 2566, 2571-2573, 2582, 2583, 2588, 2589, 2598, 2599, 2601-2603, 2606, 2613, 2615, 2632-2637, 2639, 2642, 2643, 2645, 2647, 2650, 2656-2658, 2661-2669, 2679, 2691, 2692, 2694, 2695, 2701, 2704, 2705, 2713, 2715-2717, 2722, 2723, 2726, 2727, 2728, 2730-2732, 2734-2739, 2748, 2754, 2755, 2757, 2760-2763, 2779, 2780, 2785, 2786, 2793, 2795-2797, 2801, 2804, 2808, 2811, 2812, 2817, 2825, 2826, 2830, 2833, 2836, 2837, 2840, 2841, 2846, 2848, 2849, 2857, 2864, 2871, 2872, 2875, 2876, 2897, 2900, 2917, 2918, 2929, 2933, 2935, 2936-2951, 2953, 2959, 2965, 2969, 2978, 2981, 2982, 2984-2988, 2998, 3001, 3014, 3030-3032, 3042, 3044, 3045, 3048, 3049, 3055, 3057, 3058, 3064, 3066, 3074, 3075, 3077, 3079, 3080, 3081, 3089, 3094, 3109, 3111-3113, 3117, 3122-3126, 3129, 3132, 3134-3140, 3143, 3144, 3148, 3151, 3153, 3154, 3160, 3163, 3166-3168, 3172-3174, 3181-3183, 3193-3198, 3200, 3204, 3208, 3211, 3212, 3215, 3217, 3218, 3220, 3222, 3225, 3229, 3233, 3242, 3244, 3247, 3248, 3252-3254, 3256, 3261, 3262, 3265, 3270-3274, 3277, 3284, 3287, 3289, 3290, 3292, 3302, 3304, 3313, 3318, 3321, 3326, 3334, 3388, 3390, 3392, 3393, 3396, 3398, 3404, 3408, 3410, 3412, 3417, 3418, 3420, 3422-3429, 3432, 3434, 3438, 3442-3452, 3464, 3466, 3468, 3470, 3471, 3473-3480, 3488-3491, 3494, 3496, 3500, 3501, 3503-3518, 3521-3527, 3529-3545, 3547-3557, 3559, 3561, 3562, 3566-3572, 3574-3579, 3583-3595, 3597-3618, 3621-3623, 3626, 3627, 3630, 3634, 3635, 3638-3640, 3645-3655, 3657-3663, 3666-3670, 3678, 3682-3687, 3691-3698, 3702, 3703, 3707-3719, 3722-3730, 3732-3744, 3747-3750, 3762-3768, 3771-3773, 3776-3789, 3791-3807, 3809-3833, 3837, 3838, 3843-3845, 3849-3854, 3859, 3862-3866, 3868-3876, 3881-3883, 3885, 3887-3890, 3893-3902, 3906-3908, 3910, 3912-3914, 3918, 3926-3929, 3934-3936, 3940-3944, 3947, 3949, 3951-3955, 3957-3959, 3961, 3962, 3970-3978, 3980-3985, 3992-3995, 3997-4000, 4002-4004, 4006, 4009-4011, 4014, 4018, 4019, 4022, 4029, 4030, 4032, 4036-4040, 4044-4048, 4050-4055, 4061, 4069, 4070, 4075, 4082, 4083, 4085, 4086, 4092, 4095-4097, 4105-4109, 4113, 4114, 4123, 4124, 4127-4129, 4143, 4146, 4149, 4150, 4154, 4156-4160, 4169-4171, 4174, 4175, 4178, 4179, 4186, 4189-4191, 4196-4199, 4205, 4222, 4229-4235, 4238, 4240, 4241, 4245, 4246, 4249-4252, 4259-4262, 4265-4268, 4272-4279, 4281, 4289, 4296-4298, 4300, 4302, 4303, 4305, 4308-4319, 4326, 4338-4340, 4364, 4367, 4368, 4372, 4373, 4380, 4392, 4393, 4410, 4411, 4419, 4444, 4448, 4449, 4451, 4466-4472, 4494, 4498, 4501, 4502, 4515, 4526-4530, 4532-4535, 4537, 4538-4541, 4544-4546, 4556-4573, 4575-4578, 4580-4583, 4588, 4589, 4592-4594, 4596, 4597, 4599-4601, 4604, 4605, 4612-4614, 4616, 4620, 4622-4625, 4634-4636, 4644, 4652, 4655, 4656, 4667-4670, and 4672.

In certain embodiments, the following antisense compounds or antisense oligonucleotides target a region of a DGAT2 nucleic acid and effect at least a 70% inhibition of a DGAT2 mRNA, ISIS NOs: 413236, 413433, 413446, 423437, 423440-423445, 423447, 423449, 423450, 423452-423454, 423460-423465, 423522-423528, 423601-423604, 472204, 472205, 472208, 472349-472351, 483803, 483811-483814, 483816-483818, 483825, 483826, 483828-483835, 483838-483842, 483846, 483848, 483852, 483862, 483866, 483869, 483870, 483872-483875, 483879, 483887-483890, 483892, 483895, 483897-483903, 483908-483913, 483916-483921, 483923, 483924, 483926-483928, 483934, 483948-483950, 483952, 483954, 483968-483970, 483972, 483973, 483975, 483977-483979, 483984-483989, 483992-483994, 483996, 483997, 484001, 484004, 484006, 484010, 484012, 484017, 484019, 484020, 484030, 484031, 484041, 484049, 484056, 484064, 484069, 484070, 484071, 484073, 484082, 484083, 484085, 484089, 484094, 484099-484102, 484104, 484105, 484107, 484110, 484111, 484114-484118, 484126, 484127, 484129-484131, 484133, 484135-484137, 484139-484142, 484145-484148, 484156-484158, 484161, 484167, 484169-484172, 484178, 484180-484182, 484185, 484190, 484192-484194, 484198, 484202-484204, 484209, 484211, 484215, 484217-484220, 484231, 484232, 484235, 484241, 484248, 484249, 484263, 484265, 484267-484271, 484273, 484274, 484276, 484283-484285, 484290, 484292, 484293, 484301, 484302, 484320-484322, 484324, 484327, 484336, 484342-484344, 484346, 484348-484350, 484352, 484353, 484355-484357, 484359, 484368, 484370-484378, 484381-484383, 484390, 495425, 495429, 495430, 495440-495443, 495445-495454, 495456, 495458, 495461-495473, 495476, 495479-495485, 495487-495492, 495495-495499, 495501-495511, 495514-495531, 495533-495545, 495548-495556, 495558, 495560-495566, 495568-495580, 495584, 495585, 495588-495592, 495597-495600, 495602-495610, 495612-495614, 495616-495626, 495631-495633, 495636-495639, 495641-495643, 495649, 495650, 495656, 495657, 495661, 495664, 495666, 495669-495671, 495677, 495685, 495686, 495694, 495695, 495697, 495699-495702, 495705-495707, 495711, 495714, 495718-495720, 495724, 495730, 495731, 495736-495739, 495743-495746, 495748-495754, 495756, 495757, 495762, 495763, 495766, 495772, 495782, 495784, 495785, 495789, 495794, 495795, 495800, 495804, 495808-495813, 495817-495822, 495825-495833, 495835-495837, 495838-495844, 495848-495850, 495852-495857, 495859, 495860, 495867-495869, 495873-495878, 495882, 495899-495902, 495904, 495911, 495912, 495955, 495957, 495958, 495992, 500841, 500844, 500852, 500859, 500867, 500892, 500913, 500928, 500942, 500950, 500953, 500966, 500975, 500986, 500989, 500990, 500994, 500998, 501018-501020, 501025, 501030, 501033-501035, 501038-501041, 501062, 501064, 501067, 501069, 501093, 501094, 501097, 501098, 501100, 501103, 501111, 501118, 501122, 501123, 501127, 501128, 501154, 501165, 501171, 501176, 501183, 501184, 501199, 501200, 501210, 501212-501214, 501224, 501240, 501249, 501270, 501287, 501382-501385, 501387-501396, 501398-501402, 501404-501406, 501410-501412, 501414, 501426-501430, 501435, 501436, 501438-501443, 501445, 501447-501452, 501454-501457, 501849, 501850, 501852, 501855, 501861, 501871, 501883, 501884, 501886, 501890, 501916, 501932, 501944, 501946, 501950, 501951, 501959, 501960, 501966, 501968, 501981-501983, 502013, 502015, 502025, 502026, 502037, 502040, 502045, 502046, 502056, 502083, 502098, 502099, 502106, 502110, 502119, 502120, 502131, 502135, 502154-502156, 502163, 502164, 502175, 502179, 502189, 502191, 502194, 502220, 502319, 502322, 502334, 507663, 507679, 507684, 507692-507696, 507710, 507716-507718, 507724, 522363, 522366, 522368, 522370, 522373-522375, 522383-522385, 522399, 522404-522406, 522408, 522409, 522411, 522418, 522421, 522422, 522424, 522427, 522428, 522434-522437, 522440, 522442, 522444-522446, 522450, 522452, 522457, 522462-522467, 522470, 522473, 522474, 522478, 522479, 522482, 522484-522490, 522492, 522494-522496, 522501, 522503-522505, 522509, 522510, 522518, 522529, 522534, 522540, 522542-522550, 522552-522556, 522561, 522562, 522565, 522578-522582, 522587-522592, 522602-522610, 522612-522614, 522618, 522619, 522621, 522622, 522625, 522627, 522630-522638, 522642-522645, 522657, 522658, 522661-522663, 522666, 522667, 522671-522683, 522687-522694, 522696-522702, 522705, 522706, 522709, 522710, 522714-522719, 522722-522728, 522740, 522745-522748, 522754, 522757-522759, 522761, 522766-522771, 522776-522778, 522780, 522783, 522784, 522789, 522791, 522793, 522794, 522797, 522801, 522802, 522807, 522821, 522831, 522838, 522842, 522844, 522853, 522857, 522865, 522866, 522869-522872, 522877, 522878, 522888, 522889, 522894, 522897, 522898, 522905, 522913, 522917, 522924, 522925, 522932, 522939, 522940-522943, 522947, 522950, 522964, 522965, 522996, 523000, 523002, 523026, 525395, 525401, 525402, 525415, 525431, 525442, 525443, 525468-525472, 525474, 525477, 525479, 525480, 525499-525501, 525505, 525506, 525512, 525513, 525515, 525536, 525544, 525551-525554, 525578, 525612, 525631, 525688, 525705, 525708, 525711, 525733, and 525754.

In certain embodiments, the following antisense compounds or antisense oligonucleotides target a region of a DGAT2 nucleic acid and effect at least a 70% inhibition of a DGAT2 mRNA, SEQ ID NOs: 20, 38, 39, 46, 47, 62, 63, 103, 120, 121, 131, 144, 145, 150, 152, 153, 154, 182, 183, 202, 203, 204, 221, 225, 229, 246, 259, 283, 425, 438, 452, 453, 455-458, 460, 462-477, 479, 482-485, 487-496, 504-507, 509-511, 518, 519, 521-528, 531-535, 539, 541, 545, 555, 559, 562, 563, 565-568, 574, 575, 577, 594, 595, 597, 623, 624, 627, 653, 706, 710, 740, 742-744, 749-752, 754-756, 758, 760-766, 768, 769, 789, 808-811, 841-843, 845, 846, 848, 850-852, 880, 890, 893, 895, 897, 914-916, 939, 940, 960, 961, 973, 974, 981, 991-997, 1000, 1001, 1003-1008, 1015, 1020, 1024, 1032, 1034, 1036, 1043-1045, 1047-1049, 1052, 1059-1061, 1079, 1080, 1083, 1084, 1092, 1093, 1096, 1098, 1155, 1165, 1173-1176, 1178, 1181, 1183-1189, 1194-1199, 1202-1207, 1209, 1210, 1212-1214, 1220, 1234-1236, 1238, 1240, 1254-1256, 1258, 1259, 1261, 1263-1265, 1270-1275, 1278-1280, 1282, 1283, 1287, 1290, 1292, 1296, 1298, 1303, 1305, 1306, 1316, 1317, 1327, 1335, 1342, 1350, 1355-1357, 1359, 1368, 1369, 1371, 1375, 1380, 1385-1388, 1390, 1391, 1393, 1396, 1397, 1400-1404, 1412, 1413, 1415-1417, 1419, 1421-1423, 1425-1428, 1431-1434, 1442-1444, 1447, 1453, 1455-1458, 1464, 1466-1468, 1471, 1476, 1478-1480, 1484, 1488-1490, 1495, 1497, 1501, 1503-1506, 1517, 1518, 1521, 1527, 1534, 1535, 1549, 1551, 1553-1557, 1559, 1560, 1562, 1569-1571, 1576, 1578, 1579, 1587, 1588, 1606-1608, 1610, 1613, 1622, 1628-1630, 1632, 1634-1636, 1638, 1639, 1641-1643, 1645, 1654, 1656-1664, 1667-1669, 1676, 1677, 1698, 1702, 1703, 1713-1716, 1718-1727, 1729, 1731, 1734-1746, 1749, 1752-1758, 1760-1765, 1768-1772, 1774-1784, 1787-1804, 1806-1818, 1821-1829, 1831, 1833-1839, 1841-1853, 1857, 1858, 1861-1865, 1870-1873, 1875-1883, 1885-1887, 1889-1899, 1904-1906, 1909-1912, 1914-1916, 1922, 1923, 1929, 1930, 1934, 1937, 1939, 1942-1944, 1950, 1958, 1959, 1967, 1968, 1970, 1972-1975, 1978-1980, 1984, 1987, 1991-1993, 1997, 2003, 2004, 2009-2012, 2016-2019, 2021-2027, 2029, 2030, 2035, 2036, 2039, 2045, 2055, 2057, 2058, 2062, 2067, 2068, 2073, 2077, 2081-2086, 2090-2095, 2098-2106, 2108-2117, 2121-2123, 2125-2130, 2132, 2133, 2140-2142, 2146-2151, 2155, 2172-2175, 2177, 2184, 2185, 2228, 2230, 2231, 2265, 2308, 2310-2313, 2315-2324, 2326-2330, 2332-2334, 2338-2340, 2342, 2350, 2351, 2354-2358, 2363, 2364, 2366-2371, 2373, 2375-2380, 2382-2385, 2478, 2487, 2508, 2525, 2543, 2554, 2560, 2565, 2572, 2573, 2588, 2589, 2599, 2601-2603, 2613, 2632, 2633, 2636, 2637, 2639, 2642, 2650, 2657, 2661, 2662, 2666, 2667, 2691, 2695, 2715-2717, 2722, 2727, 2730-2732, 2735-2738, 2755, 2757, 2760, 2762, 2779, 2793, 2801, 2804, 2817, 2826, 2837, 2840, 2841, 2846, 2849, 2857, 2864, 2872, 2897, 2918, 2947, 2948, 2950, 2953, 2959, 2969, 2981, 2982, 2984, 2988, 3014, 3030, 3042, 3044, 3048, 3049, 3057, 3058, 3064, 3066, 3079-3081, 3111, 3113, 3123, 3124, 3135, 3138, 3143, 3144, 3154, 3173, 3181, 3196, 3197, 3204, 3208, 3217, 3218, 3229, 3233, 3252-3254, 3261, 3262, 3273, 3277, 3287, 3289, 3292, 3318, 3388, 3393, 3404, 3412, 3417, 3420, 3425-3429, 3432, 3443, 3449-3451, 3464, 3468, 3471, 3473, 3475, 3478-3480, 3488-3490, 3504, 3509-3511, 3513-3516, 3523, 3526, 3527, 3529, 3532, 3533, 3539-3542, 3545, 3547, 3549-3551, 3555, 3557, 3562, 3567-3572, 3575, 3578, 3579, 3583, 3584, 3587, 3589-3595, 3597, 3599-3601, 3606, 3608-3610, 3614, 3615, 3623, 3634, 3639, 3645, 3647-3655, 3657-3661, 3666, 3667, 3670, 3683-3687, 3692-3697, 3707-3715, 3717-3719, 3723, 3724, 3726, 3727, 3730, 3732, 3735-3743, 3747-3750, 3762, 3763, 3766-3768, 3771, 3772, 3776-3788, 3792-3799, 3801-3807, 3810, 3811, 3814, 3815, 3819-3824, 3827-3833, 3845, 3850-3853, 3859, 3862-3864, 3866, 3871-3876, 3881-3883, 3885, 3888, 3889, 3894, 3896, 3898, 3899, 3902, 3906, 3907, 3912, 3926, 3936, 3943, 3947, 3949, 3958, 3962, 3970, 3971, 3974-3977, 3982, 3983, 3993, 3994, 3999, 4002, 4003, 4010, 4018, 4022, 4029, 4030, 4037, 4044-4048, 4052, 4055, 4069, 4070, 4096, 4123, 4127, 4129, 4150, 4156, 4157, 4170, 4186, 4197, 4198, 4229-4233, 4235, 4238, 4240, 4241, 4260-4262, 4266, 4267, 4273, 4274, 4276, 4297, 4305, 4312-4315, 4339, 4373, 4392, 4449, 4466, 4469, 4472, 4494, 4515, 4526-4530, 4532, 4533, 4535, 4537-4540, 4545, 4546, 4558-4560, 4562-4570, 4573, 4575, 4576, 4578, 4580, 4582, 4588, 4589, 4592, 4596, 4600, 4601, 4604, 4612-4614, 4616, 4622-4625, 4634, 4635, 4652, 4667, and 4668.

In certain embodiments, the following antisense compounds or antisense oligonucleotides target a region of a DGAT2 nucleic acid and effect at least an 80% inhibition of a DGAT2 mRNA, ISIS NOs: 413433, 423463, 423464, 423523, 423524, 423526, 472351, 483817, 483825, 483826, 483828, 483830-483835, 483839-483841, 483848, 483852, 483866, 483869, 483870, 483873-483875, 483887, 483889, 483890, 483895, 483897, 483898, 483900, 483901, 483908-483910, 483913, 483916, 483919, 483921, 483923, 483924, 483927, 483952, 483968-483970, 483972, 483984, 483986-483988, 483992, 483993, 483996, 483997, 484004, 484017, 484031, 484041, 484049, 484064, 484070, 484085, 484094, 484099, 484100, 484115-484117, 484126, 484127, 484129-484131, 484133, 484137, 484139-484141, 484148, 484156-484158, 484167, 484169-484171, 484181, 484182, 484192, 484193, 484203, 484204, 484209, 484215, 484217, 484218, 484220, 484231, 484235, 484249, 484267-484271, 484273, 484283, 484284, 484292, 484293, 484301, 484327, 484336, 484343, 484344, 484348, 484350, 484353, 484357, 484368, 484377, 484378, 495425, 495429, 495440, 495442, 495446, 495449-495451, 495453, 495454, 495463, 495464, 495466, 495467, 495469-495472, 495481, 495482, 495484, 495485, 495488-495492, 495495-495498, 495505-495510, 495514-495531, 495533-495537, 495539-495541, 495543-495545, 495550-495556, 495560, 495561-495564, 495566, 495568-495578, 495585, 495591, 495598-495600, 495604, 495606, 495608, 495609, 495618-495622, 495639, 495649, 495650, 495685, 495686, 495697, 495702, 495705-495707, 495718, 495730, 495736, 495738, 495739, 495744, 495745, 495749, 495751-495753, 495756, 495785, 495808-495810, 495817-495820, 495822, 495825-495832, 495835-495844, 495849, 495852-495854, 495856, 495857, 495867-495869, 495874-495878, 495902, 495992, 500859, 500867, 500913, 500998, 501020, 501034, 501035, 501064, 501094, 501098, 501100, 501103, 501127, 501183, 501199, 501213, 501385, 501387-501393, 501396, 501398, 501404-501406, 501411, 501412, 501427-501430, 501435, 501436, 501438, 501440, 501442, 501443, 501447-501452, 501454-501855, 501861, 501884, 501944, 501950, 501983, 502040, 502046, 502056, 502083, 502099, 502119, 502154, 502164, 502175, 502179, 502189, 502191, 502319, 507692, 507694, 507696, 507717, 522366, 522373-522375, 522383, 522435-522437, 522444, 522445, 522450, 522465, 522473, 522484, 522485, 522495, 522501, 522509, 522529, 522546, 522550, 522553-522556, 522579-522582, 522587-522589, 522606-522610, 522618, 522621, 522627, 522630-522632, 522634, 522638, 522643, 522645, 522667, 522671, 522672, 522674-522683, 522687-522692, 522694, 522696-522700, 522705, 522709, 522715-522719, 522745, 522757, 522770, 522783, 522784, 522807, 522865, 522866, 522888, 522889, 522897, 522913, 522942, 522964, 523002, 525401, 525469, 525470, 525501, and 525612.

In certain embodiments, the following antisense compounds or antisense oligonucleotides target a region of a DGAT2 nucleic acid and effect at least a 80% inhibition of a DGAT2 mRNA, SEQ ID NOs: 103, 120, 121, 131, 144, 145, 150, 152, 153, 182, 204, 246, 259, 283, 425, 456, 457, 462, 463, 467-469, 487-490, 504, 506, 509, 510, 518, 519, 521, 523, 524-528, 532-534, 541, 545, 559, 562, 563, 566-568, 594, 742, 750, 751, 762, 808-810, 843, 845, 893, 915, 939, 973, 993-995, 997, 1000, 1001, 1005, 1006, 1008, 1034, 1060, 1061, 1079, 1084, 1173, 1175, 1176, 1181, 1183, 1184, 1186, 1187, 1194-1196, 1199, 1202, 1205, 1207, 1209, 1210, 1213, 1238, 1254-1256, 1258, 1270, 1272-1274, 1278, 1279, 1282, 1283, 1290, 1303, 1317, 1327, 1335, 1350, 1356, 1371, 1380, 1385, 1386, 1401-1403, 1412, 1413, 1415-1417, 1419, 1423, 1425-1427, 1434, 1442-1444, 1453, 1455-1457, 1467, 1468, 1478, 1479, 1489, 1490, 1495, 1501, 1503, 1504, 1506, 1517, 1521, 1535, 1553-1557, 1559, 1569, 1570, 1578, 1579, 1587, 1613, 1622, 1629, 1630, 1634, 1636, 1639, 1643, 1654, 1663, 1664, 1677, 1698, 1702, 1713, 1715, 1719, 1722-1724, 1726, 1727, 1736, 1737, 1739, 1740, 1742-1745, 1754, 1755, 1757, 1758, 1761-1765, 1768-1771, 1778-1783, 1787-1804, 1806-1810, 1812-1814, 1816-1818, 1823-1829, 1833-1837, 1839, 1841-1851, 1858, 1864, 1871-1873, 1877, 1879, 1881, 1882, 1891-1895, 1912, 1922, 1923, 1958, 1959, 1970, 1975, 1978-1980, 1991, 2003, 2009, 2011, 2012, 2017, 2018, 2022, 2024-2026, 2029, 2058, 2081-2083, 2090-2093, 2095, 2098-2105, 2108-2117, 2122, 2125-2127, 2129, 2130, 2140-2142, 2147-2151, 2175, 2265, 2313, 2315-2321, 2324, 2326, 2332-2334, 2339, 2340, 2355-2358, 2363, 2364, 2366, 2368, 2370, 2371, 2375-2380, 2382, 2383, 2572, 2588, 2602, 2633, 2637, 2639, 2642, 2666, 2695, 2717, 2731, 2732, 2757, 2864, 2872, 2918, 2953, 2959, 2982, 3042, 3048, 3081, 3138, 3144, 3154, 3181, 3197, 3217, 3252, 3262, 3273, 3277, 3287, 3289, 3404, 3417, 3425, 3427, 3429, 3450, 3471, 3478-3480, 3488, 3540-3542, 3549, 3550, 3555, 3570, 3578, 3589, 3590, 3600, 3606, 3614, 3634, 3651, 3655, 3658-3661, 3684-3687, 3692-3694, 3711-3715, 3723, 3726, 3732, 3735-3737, 3739, 3743, 3748, 3750, 3772, 3776, 3777, 3779-3788, 3792-3797, 3799, 3801-3803, 3805, 3810, 3814, 3820-3824, 3850, 3862, 3875, 3888, 3889, 3912, 3970, 3971, 3993, 3994, 4002, 4018, 4047, 4069, 4129, 4156, 4230, 4231, 4262, 4373, 4526, 4529, 4532, 4538, 4540, 4560, 4562-4564, 4566-4570, 4578, 4623, 4625, and 4667.

In certain embodiments, the following antisense compounds or antisense oligonucleotides target a region of a DGAT2 nucleic acid and effect at least a 90% inhibition of a DGAT2 mRNA, ISIS NOs: 413433, 423463, 483817, 483825, 483834, 483848, 483866, 483869, 483873, 483874, 483895, 483898, 483908, 483910, 483913, 483952, 484085, 484148, 484157, 484170, 484181, 484231, 484271, 484283, 484350, 484353, 495449, 495450, 495495, 495498, 495505, 495506, 495516-495520, 495522-495524, 495526, 495527, 495535, 495553-495555, 495562, 495563, 495570, 495571, 495575-495577, 495620, 495752, 495809, 495825, 495829, 495836, 495837, 495839-495842, 495853, 495857, 495876, 495878, 501385, 501387, 501404, 501412, 501427, 501430, 501442, 501443, 501447, 501448, 501450, 501452, 501861, 522632, 522688, and 522745.

In certain embodiments, the following antisense compounds or antisense oligonucleotides target a region of a DGAT2 nucleic acid and effect at least a 90% inhibition of a DGAT2 mRNA, SEQ ID NOs: 283, 425, 457, 467, 510, 518, 527, 541, 559, 562, 566, 567, 1181, 1184, 1194, 1196, 1199, 1238, 1371, 1434, 1443, 1456, 1467, 1517, 1557, 1569, 1636, 1639, 1722, 1723, 1768, 1771, 1778, 1779, 1789-1793, 1795-1797, 1799, 1800, 1808, 1826-1828, 1835, 1836, 1843, 1844, 1848-1850, 1893, 2025, 2082, 2098, 2102, 2109, 2110, 2112-2115, 2126, 2130, 2149, 2151, 2313, 2315, 2332, 2340, 2355, 2358, 2370, 2371, 2375, 2376, 2378, 2380, 2959, 3737, 3793, 3850, 4562, 4564, 4566, 4568, and 4569.

In certain embodiments, a compound comprises a modified oligonucleotide consisting of 8 to 80 linked nucleosides having at least an 8, 9, 10, 11, 12, 13, 14, 15, or 16 contiguous nucleobase portion complementary to an equal length portion within nucleotides 26778-26797, 23242-23261, 26630-26649, 15251-15270, 28026-28045, 35436-35455, 10820-10836, 23246-23262 of SEQ ID NO: 2

In certain embodiments, a compound comprises a modified oligonucleotide consisting of 10 to 30 linked nucleosides complementary within nucleotides 26778-26797, 23242-23261, 26630-26649, 15251-15270, 28026-28045, 35436-35455, 10820-10836, 23246-23262 of SEQ ID NO: 2.

In certain embodiments, a compound comprises a modified oligonucleotide consisting of 8 to 80 linked nucleosides having a nucleobase sequence comprising at least an 8, 9, 10, 11, 12, 13, 14, 15, or 16 contiguous nucleobase portion any one of SEQ ID NOs: 1423, 1371, 1415, 1849, 2959, 3292, 4198, and 4373.

In certain embodiments, a compound comprises a modified oligonucleotide consisting of 10 to 30 linked nucleosides having a nucleobase sequence comprising any one of SEQ ID NOs: 1423, 1371, 1415, 1849, 2959, 3292, 4198, and 4373.

In certain embodiments, a compound comprises a modified oligonucleotide having a nucleobase sequence consisting of any one of SEQ ID NOs: 1423, 1371, 1415, 1849, 2959, 3292, 4198, and 4373. In certain embodiments, a modified oligonucleotide targeted to DGAT2 is ISIS 484137, 484085, 484129, 495576, 501861, 502194, 525443, and 525612.

In certain embodiments, a modified oligonucleotide targeted to DGAT2 is ISIS 484137, 484085, 484129, 495576, 501861, 502194, 525443, and 525612. Out of about 5,000 antisense oligonucleotides that were screened as described in the Examples section below, ISIS 484137, 484085, 484129, 495576, 501861, 502194, 525443, and 525612 emerged as the top lead compounds. In particular, ISIS 484137 exhibited the best combination of properties in terms of potency and tolerability out of about 5,000 antisense oligonucleotides.

In certain embodiments, any of the foregoing compounds or oligonucleotides comprises at least one modified internucleoside linkage, at least one modified sugar, and/or at least one modified nucleobase.

In certain aspects, any of the foregoing compounds or oligonucleotides comprises at least one modified sugar. In certain aspects, at least one modified sugar comprises a 2'-O-methoxyethyl group. In certain aspects, at least one modified sugar is a bicyclic sugar, such as a 4'-CH(CH$_3$)—O-2' group, a 4'-CH$_2$—O-2' group, or a 4'-(CH$_2$)$_2$—O-2'group.

In certain aspects, the modified oligonucleotide comprises at least one modified internucleoside linkage, such as a phosphorothioate internucleoside linkage.

In certain embodiments, any of the foregoing compounds or oligonucleotides comprises at least one modified nucleobase, such as 5-methylcytosine.

In certain embodiments, any of the foregoing compounds or oligonucleotides comprises:

a gap segment consisting of linked 2'-deoxynucleosides;

a 5' wing segment consisting of linked nucleosides; and a 3' wing segment consisting of linked nucleosides;

wherein the gap segment is positioned between the 5' wing segment and the 3' wing segment and wherein each nucleoside of each wing segment comprises a modified sugar. In certain embodiments, the oligonucleotide consists of 8 to 80 linked nucleosides having a nucleobase sequence comprising the sequence recited in SEQ ID NO: 1423, 1371, 1415, 1849, 2959, 3292, 4198, and 4373. In certain aspects, the oligonucleotide consists of 10 to 30 linked nucleosides having a nucleobase sequence comprising the sequence recited in SEQ ID NO: 1423, 1371, 1415, 1849, 2959, 3292, 4198, and 4373.

In certain aspects, the modified oligonucleotide has a nucleobase sequence comprising the sequence recited in SEQ ID NO: 1423, 1371, 1415, 1849, 2959, or 3292, wherein the modified oligonucleotide comprises a gap segment consisting of ten linked 2'-deoxynucleosides;

a 5' wing segment consisting of five linked nucleosides; and a 3' wing segment consisting of five linked nucleosides;

wherein the gap segment is positioned between the 5' wing segment and the 3' wing segment, wherein each nucleoside of each wing segment comprises a 2'-O-methoxyethyl sugar; wherein each internucleoside linkage is a phosphorothioate linkage and wherein each cytosine is a 5-methylcytosine. In certain embodiments, the modified oligonucleotide consists of 20-80 linked nucleosides. In certain embodiments, the modified oligonucleotide consists of 20-30 linked nucleosides.

In certain aspects, the modified oligonucleotide has a nucleobase sequence comprising the sequence recited in SEQ ID NO: 4198 or 4373, wherein the modified oligonucleotide comprises a gap segment consisting of ten linked 2'-deoxynucleosides;

a 5' wing segment consisting of three linked nucleosides; and a 3' wing segment consisting of four linked nucleosides;

wherein the gap segment is positioned between the 5' wing segment and the 3' wing segment, wherein each nucleoside of each wing segment comprises a 2'-O-methoxyethyl sugar; wherein each internucleoside linkage is a phosphorothioate linkage and wherein each cytosine is a 5-methylcytosine. In certain embodiments, the modified oligonucleotide consists of 17-80 linked nucleosides. In certain embodiments, the modified oligonucleotide consists of 17-30 linked nucleosides.

In certain embodiments, a compound comprises or consists of ISIS 484137 and has the following chemical structure or a salt thereof:

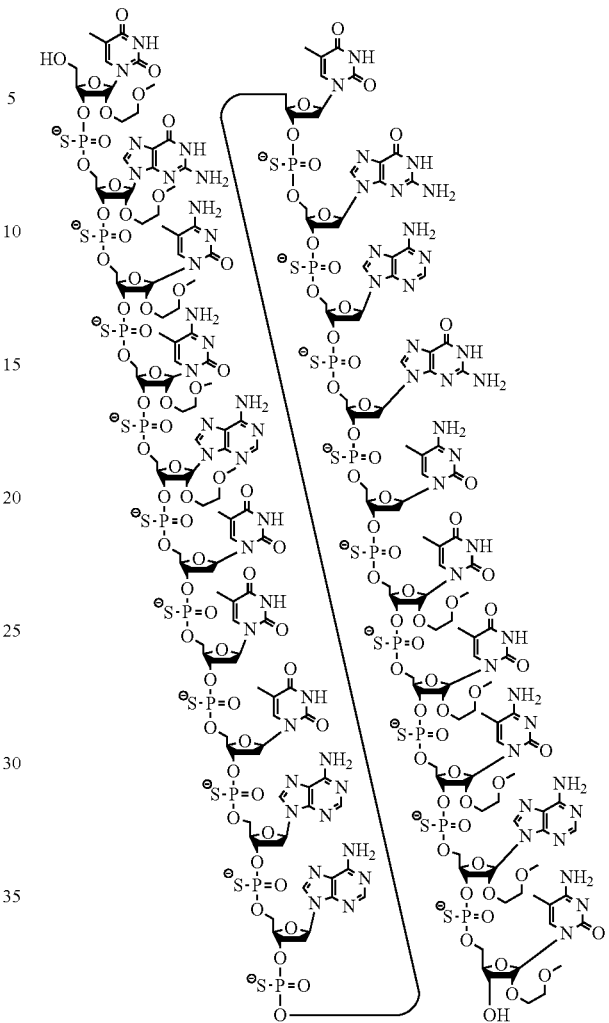

In certain embodiments, a compound comprises or consists of ISIS 484137, named by accepted oligonucleotide nomenclature, showing each 3'-O to 5'-O-linked phosphorothioate diester internucleotide linkage as follows:

2'-O-(2-methoxyethyl)-5-methyl-P-thiouridylyl-(3'-O→5'-O)-2'-O-(2-methoxyethyl)-P-thioguanylyl-(3'-O→5'-O)-2'-O-(2-methoxyethyl)-5-methyl-P-thiocytidylyl-(3'-O→5-O)-2'-O-(2-methoxyethyl)-5-methyl-P-thiocytidylyl-(3'-O→5'-O)-2'-O-(2-methoxyethyl)-P-thioadenylyl-(3'-O→5'-O)—P-thiothymidylyl-(3'-O→5'-O)—P-thiothymidylyl-(3'-O→5 thiothymidylyl-(3'-O→5'-O)-2'-deoxy-P-thioadenylylnylyl-(3'-O→5'-O)-2'-deoxy-P-thioadenylyl-(3'-O→5'-O)—P-thiothymidylyl-(3'-O→5'-O)-2'-deoxy-P-thioguanylyl-(3'-O→5'-O)-2'-deoxy-P-thioadenylyl-(3'-O→5'-O)-2'-deoxy-P-thioguanylyl-(3'-O→5'-O)-2'-deoxy-5-methyl-P-thiocytidylyl-(3-O→5'-O)-2'-O-(2-methoxyethyl)-5-methyl-P-thiouridylyl-(3'-O→5'-O)-2'-O-(2-methoxyethyl)-5-methyl-P-thiouridylyl-(3'-O→5'-O)-2'-O-(2-methoxyethyl)-5-methyl-P-thiocytidylyl-(3'-O→5'-O)-2'-O-(2-methoxyethyl)-P-thioadenylyl-(3'-O→5'-O)-2'-O-(2-methoxyethyl)-5-methyl-cytidine, 19 sodium salt.

In any of the foregoing embodiments, the compound or oligonucleotide can be at least 85%, at least 90%, at least 95%, at least 98%, at least 99%, or 100% complementary to a nucleic acid encoding DGAT2.

In any of the foregoing embodiments, the antisense compound can be a single-stranded oligonucleotide.

In any of the foregoing embodiments, the oligonucleotide can consist of 8 to 80, 10 to 30, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked nucleosides.

In certain embodiments, compounds or compositions provided herein comprise a salt of the modified oligonucleotide.

group is linked to the modified oligonucleotide at the 3' end of the modified oligonucleotide. In certain embodiments, the conjugate group comprises at least one N-Acetylgalactosamine (GalNAc), at least two N-Acetylgalactosamines (GalNAcs), or at least three N-Acetylgalactosamines (GalNAcs).

In certain embodiments, a compound having the following chemical structure comprises or consists of ISIS 484137 or salt thereof with a conjugate group comprising GalNAc as described herein:

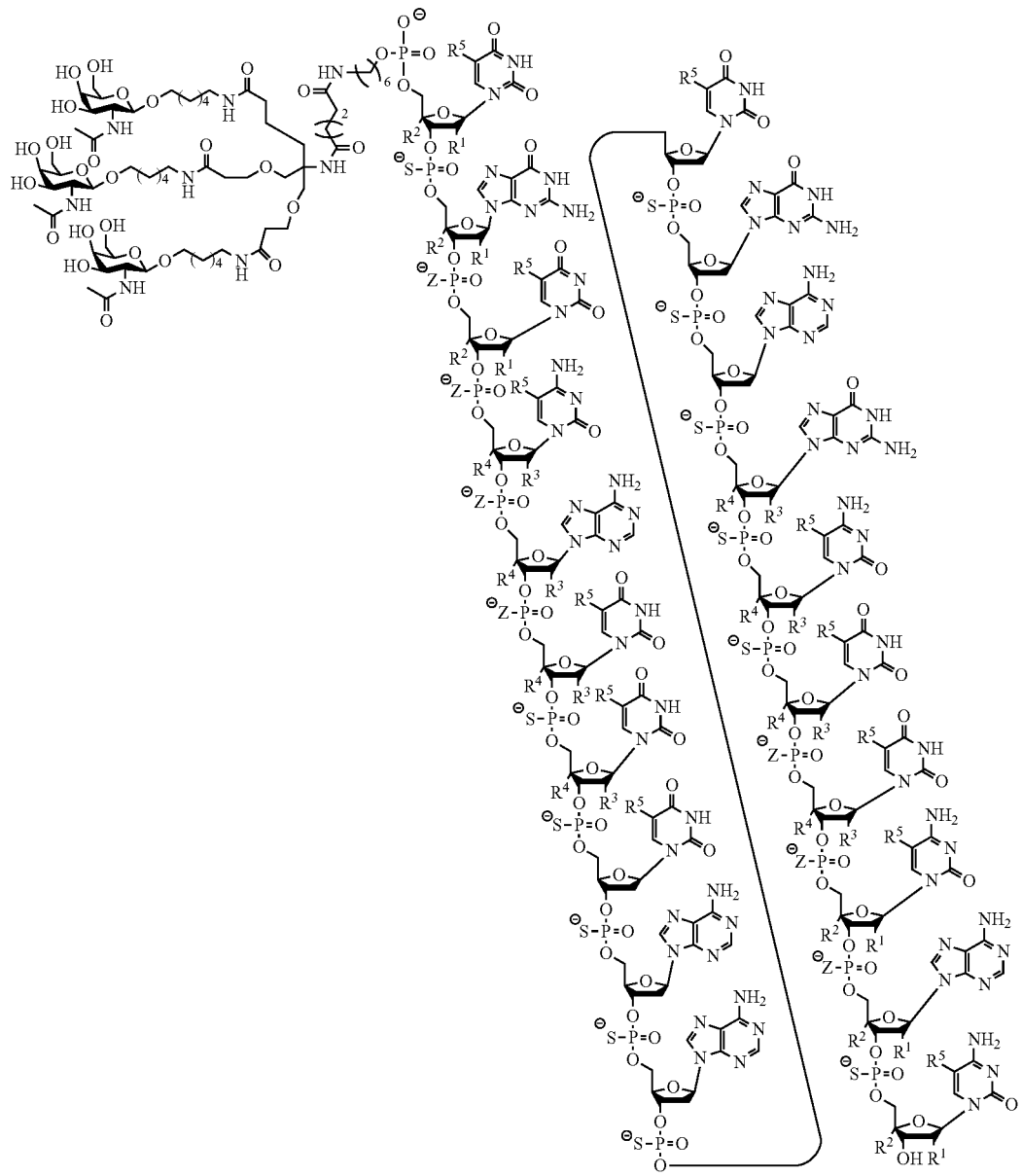

In certain embodiments, the salt is a sodium salt. In certain embodiments, the salt is a potassium salt.

In certain embodiments, a compound comprises a modified oligonucleotide described herein and a conjugate group. In certain embodiments, the conjugate group is linked to the modified oligonucleotide at the 5' end of the modified oligonucleotide. In certain embodiments, the conjugate wherein for each pair of $R_1$ and $R_2$ on the same ring, independently for each ring, either $R_1$ is —$OCH_2CH_2OCH_3$ (MOE) and $R_2$ is H; or $R_1$ and $R_2$ together form a bridge, wherein $R_1$ is —O— and $R_2$ is —$CH_2$—, —$CH(CH_3)$—, or —$CH_2CH_2$—, and $R_1$ and $R_2$ are directly connected such that the resulting bridge is selected from: —O—$CH_2$—, —O—$CH(CH_3)$—, and —O—$CH_2CH_2$—; and for each pair of R₃ and R₄ on the same ring, independently for each ring: either R₃ is selected from H and —OCH₂CH₂OCH₃ and R₄ is H; or R₃ and R₄ together form a bridge, wherein R₃ is —O—, and R₄ is —CH₂—, —CH(CH₃)—, or —CH₂CH₂—, and R₃ and R₄ are directly connected such that the resulting bridge is selected from: —O—CH₂—, —O—CH(CH₃)—, and —O—CH₂CH₂—; and each R₅ is independently selected from H and —CH₃; and each Z is independently selected from S— and O—.

In certain embodiments, a compound comprises or consists of SEQ ID NO: 1423, 5'-GalNAc, and chemical modifications as represented by the following chemical structure:

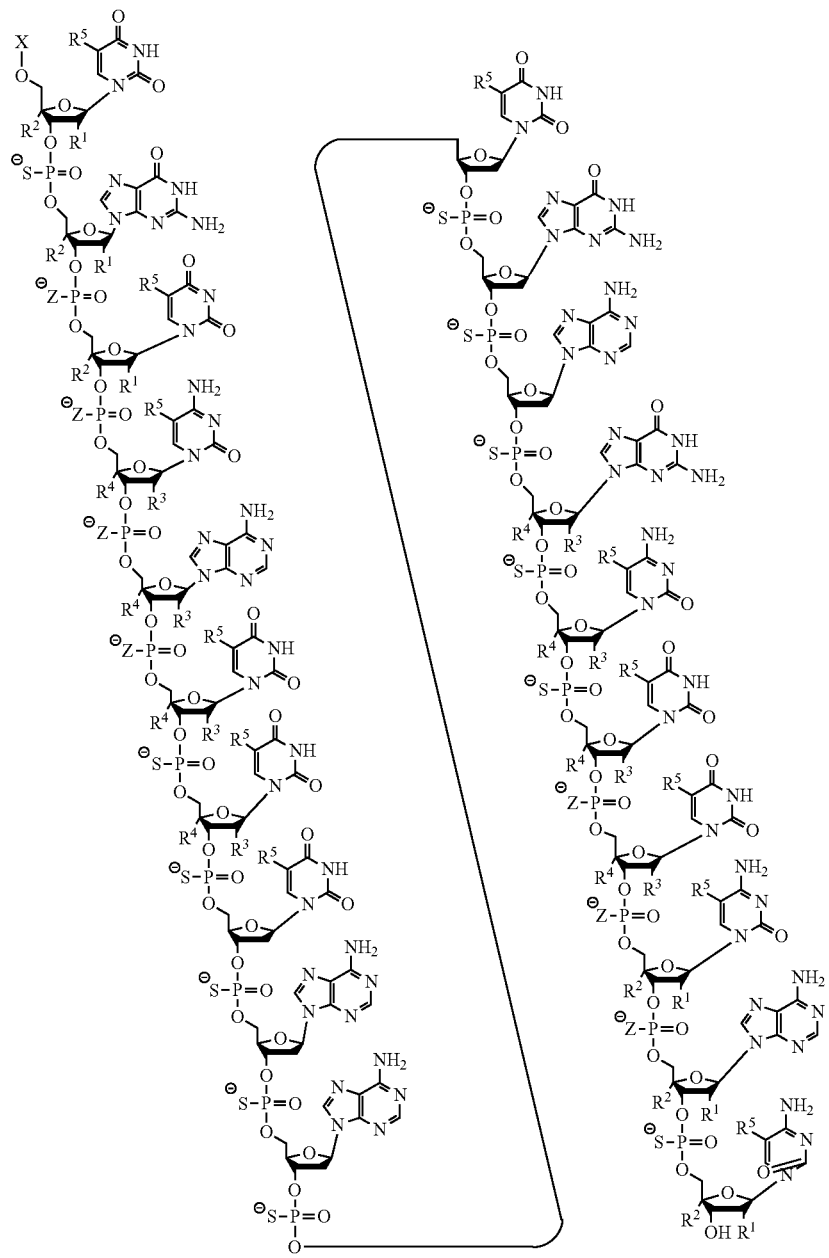

wherein for each pair of R₁ and R₂ on the same ring, independently for each ring, either R₁ is —OCH₂CH₂OCH₃ (MOE) and R₂ is H; or R₁ and R₂ together form a bridge, wherein R₁ is —O— and R₂ is —CH₂—, —CH(CH₃)—, or —CH₂CH₂—, and R₁ and R₂ are directly connected such that the resulting bridge is selected from: —O—CH₂—, —O—CH(CH₃)—, and —O—CH₂CH₂—; and for each pair of R₃ and R₄ on the same ring, independently for each ring: either R₃ is selected from H and —OCH₂CH₂OCH₃ and R₄ is H; or R₃ and R₄ together form a bridge, wherein R₃ is —O—, and R₄ is —CH₂—, —CH(CH₃)—, or —CH₂CH₂—, and R₃ and R₄ are directly connected such that the resulting bridge is selected from: —O—CH₂—, —O—CH(CH₃)—, and —O—CH₂CH₂—; and each R₅ is independently selected from H and —CH₃; and each Z is independently selected from S— and O—; and X is H or a conjugate group that optionally comprises a conjugate linker and/or cleavable moiety.

In certain embodiments, a compound comprises ISIS 769355 or salt thereof. In certain embodiments, a compound consists of ISIS 769355 or salt thereof. In certain embodiments, ISIS 769355 has the following chemical structure:
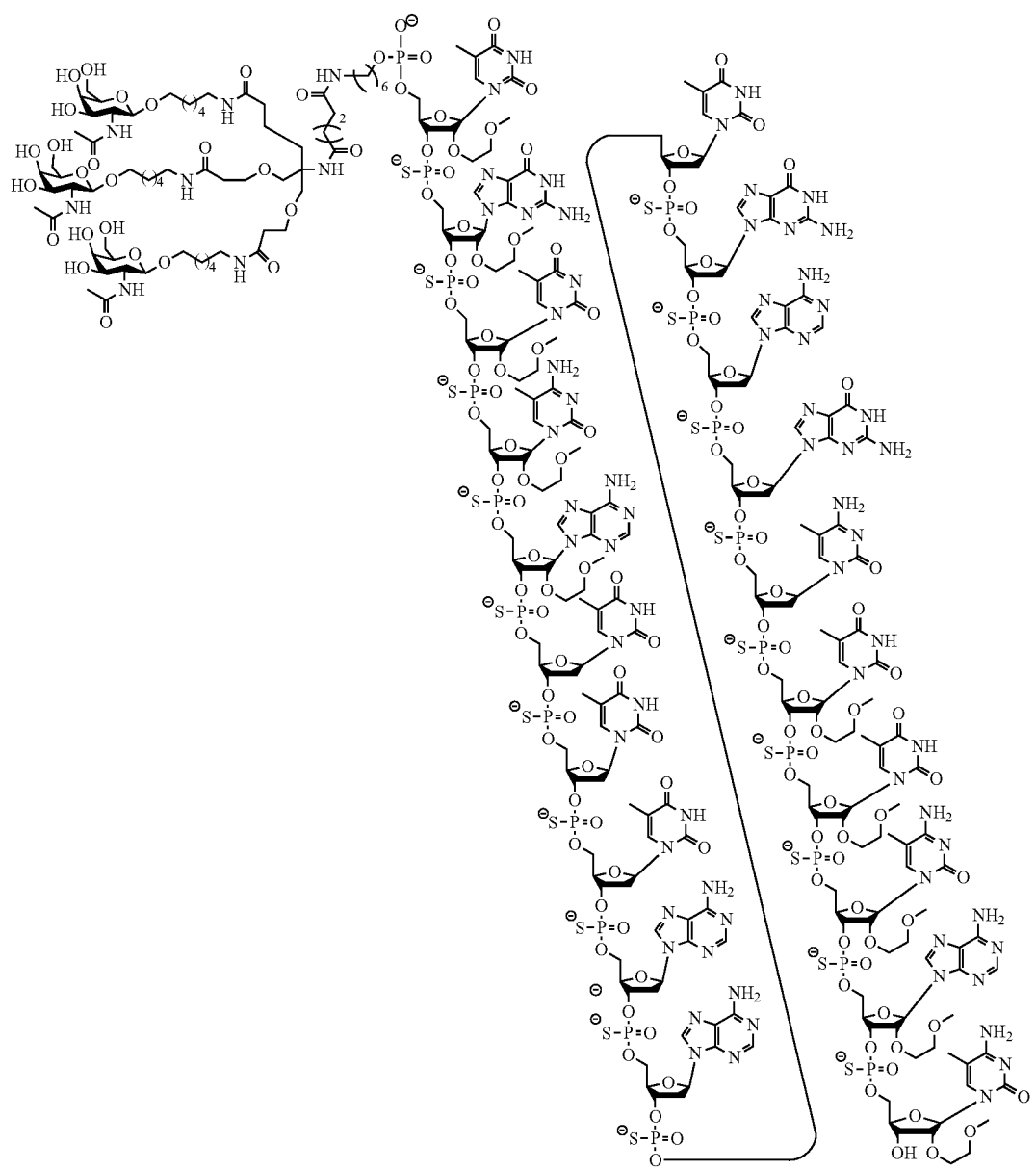

In certain embodiments, a compound comprises ISIS 769356 or salt thereof. In certain embodiments, a compound consists of ISIS 769356 or salt thereof. In certain embodiments, ISIS 769356 has the following chemical structure:
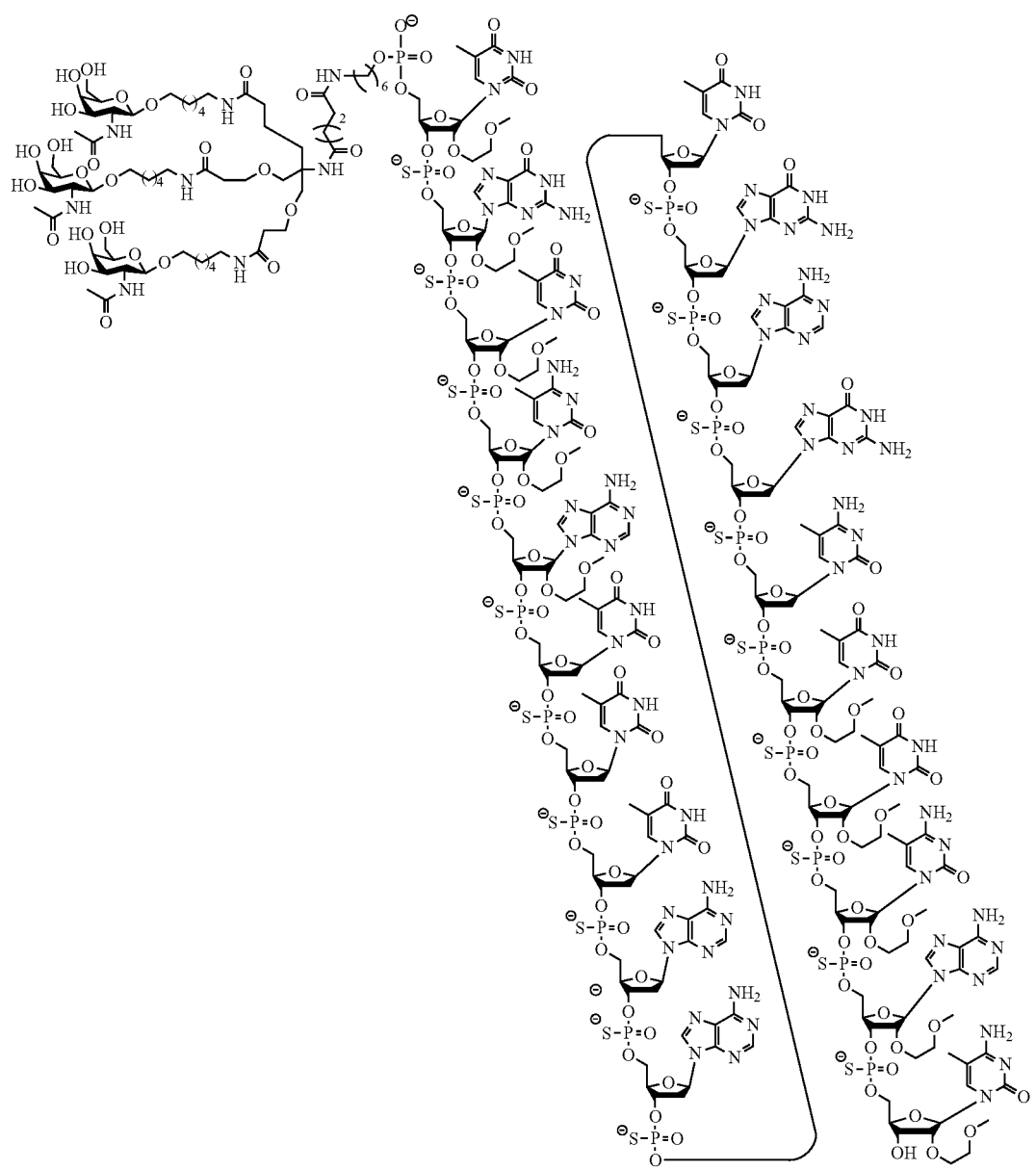

In certain embodiments, a compound comprises ISIS 769357 or salt thereof. In certain embodiments, a compound consists of ISIS 769357 or salt thereof. In certain embodiments, ISIS 769357 has the following chemical structure:
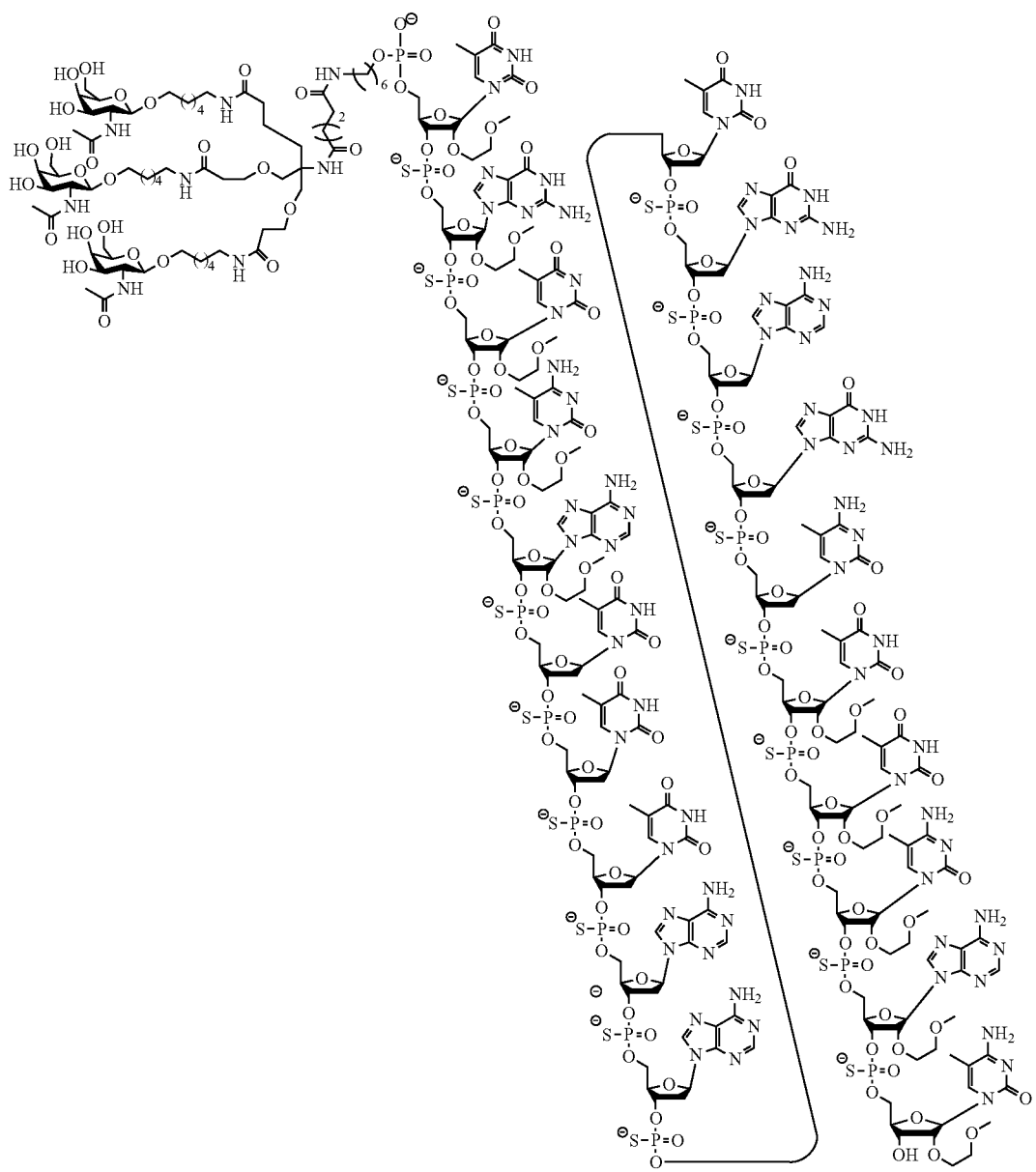

In certain embodiments, the salt of ISIS 769357 is a sodium salt, and has the following chemical structure:
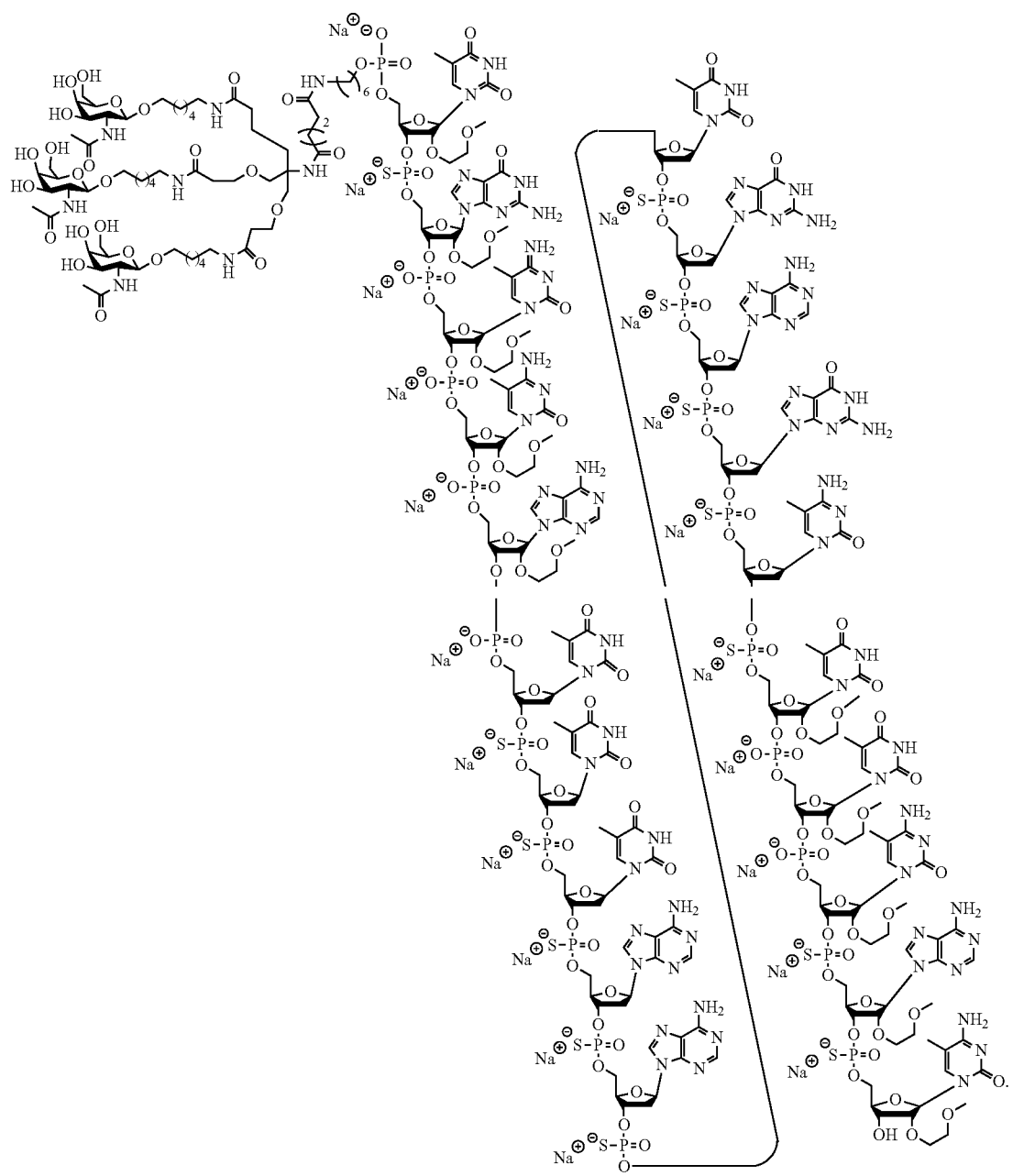

In certain embodiments, ISIS 769357 has the following chemical structure:

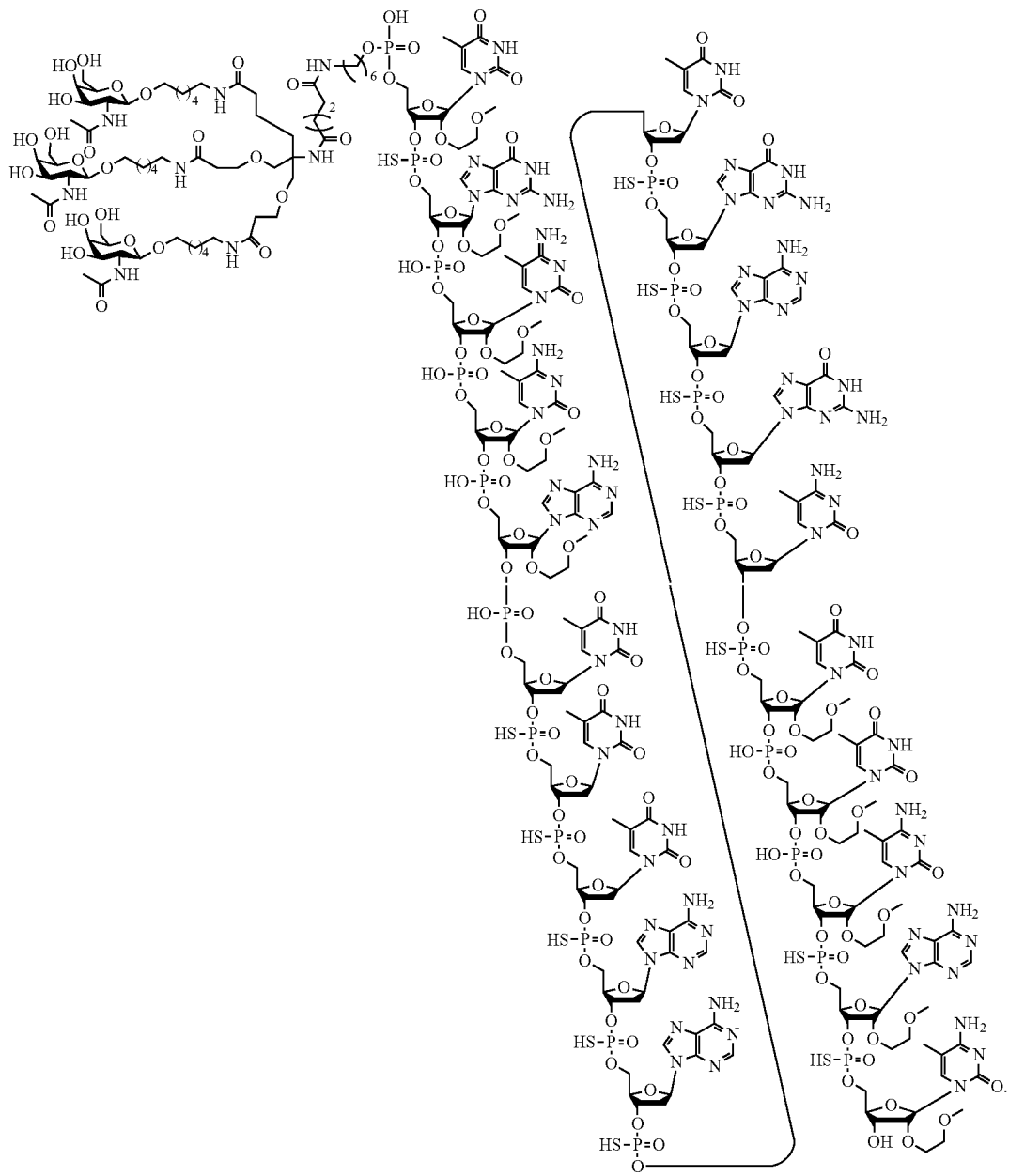

Certain embodiments provide compositions comprising any of the compounds comprising or consisting of a modified oligonucleotide targeted to DGAT2 or salt thereof and a conjugate group, and at least one of a pharmaceutically acceptable carrier or diluent.

In certain embodiments, the compounds or compositions as described herein are efficacious by virtue of having at least one of an in vitro $IC_{50}$ of less than 2 nM, less than 3 nM, less than 4 nM, less than 5 nM, less than 6 nM, less than 7 nM, less than 8 nM, less than 9 nM, less than 10 nM, less than 20 nM, less than 30 nM, less than 35 nM, less than 40 nM, less than 45 nM, less than 50 nM, less than 60 nM, less than 70 nM, less than 80 nM, less than 90 nM, less than 100 nM, less than 110 nM, less than 300 nM, less than 400 nM, less than 500 nM, less than 600 nM, less than 700 nM, less than 800 nM, less than 900 nM, less than 1 μM, less than 1.1 μM, less than 1.2 μM, less than 1.3 μM, less than 1.4 μM, less than 1.5 μM, less than 1.6 μM, less than 1.7 μM, less than 1.8 μM, less than 1.9 μM, less than 2 μM, less than 2.5 μM, less than 3 μM, less than 3.5 μM, less than 4 μM, less than 4.5 μM, less than 5 μM, less than 5.5 μM, less than 6 μM, less than 6.5 μM, or less than 10 μM.

In certain embodiments, the compounds or compositions as described herein are highly tolerable as demonstrated by having at least one of an increase an ALT or AST value of no more than 4 fold, 3 fold, or 2 fold over saline treated animals or an increase in liver, spleen, or kidney weight of no more than 30%, 20%, 15%, 12%, 10%, 5%, or 2%. In certain embodiments, the compounds or compositions as described herein are highly tolerable as demonstrated by having no increase of ALT or AST over saline treated animals. In certain embodiments, the compounds or compositions as described herein are highly tolerable as demonstrated by having no increase in liver, spleen, or kidney weight over saline treated animals.

Certain Indications

Certain embodiments provided herein relate to methods of treating, preventing, or ameliorating a disease associated with DGAT2 in an individual by administration of a DGAT2 specific inhibitor, such as an antisense compound targeted to DGAT2.

Examples of diseases associated with DGAT2 treatable, preventable, and/or ameliorable with the methods provided herein include nonalcoholic fatty liver diseases (NAFLD), nonalcoholic steatohepatitis (NASH), hepatic steatosis, fatty liver diseases, lipodystrophy syndromes, including congential generalized lipodystrophy (CGL), acquired generalized lipodystrophy (AGL), familial partial lipodystrophy (FPL), and acquired partial lipodystrophy (PL), metabolic syndrome and cardiovascular diseases.

In certain embodiments, a method of treating, preventing, or ameliorating a disease associated with NAFLD in an individual comprises administering to the individual a specific inhibitor of DGAT2, thereby treating, preventing, or ameliorating the disease. In certain embodiments, a method of treating, preventing, or ameliorating a disease associated with lipodystrophy syndrome in an individual comprises administering to the individual a specific inhibitor of DGAT2, thereby treating, preventing, or ameliorating the disease. In certain embodiments, the lipodystrophy syndrome is partial lipodystrophy. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide.

In certain embodiments, a method of treating, preventing, or ameliorating NAFLD/NASH comprises administering to the individual a DGAT2 specific inhibitor, thereby treating, preventing, or ameliorating NALFD/NASH. In certain embodiments, a method of treating, preventing, or ameliorating lipodystrophy comprises administering to the individual a DGAT2 specific inhibitor, thereby treating, preventing, or ameliorating lipodystrophy syndrome. In certain embodiments, the lipodystrophy syndrome is partial lipodystrophy. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide. In certain aspects, the antisense compound is administered to the individual parenterally. In certain aspects, administering the antisense compound results in specific reduction of DGAT2 expression, reduction in the rate of triglyceride synthesis, improvement of hepatic steatosis and blood lipid levels, reduction of hepatic lipids, reversal of diet-induced hepatic insulin resistance, and improvement in hepatic insulin sensitivity. In certain aspects, administering the antisense compound results in reduction in liver steatosis and fibrosis. In certain aspects, administering the antisense compound results in improvements in ALT levels. In certain aspects, administering the antisense compound results in decrease in NAFLD Activity Score (NAS). In certain aspects, administering the antisense compound results in reduction in serum total cholesterol and triglycerides. In certain aspects, administering the antisense compound results in neutral insulin sensitivity and glycemic control. In certain aspects, administering the antisense compound results in improved insulin sensitivity and glycemic control. In certain aspects, the individual is identified as having or at risk of having a disease associated with NAFLD. In certain aspects, the individual is identified as having or at risk of having a disease associated with lipodystrophy syndrome.

In certain embodiments, a method of inhibiting expression of DGAT2 in an individual having, or at risk of having, a disease associated with NAFLD comprises administering a DGAT2 specific inhibitor to the individual, thereby inhibiting expression of DGAT2 in the individual. In certain embodiments, a method of inhibiting expression of DGAT2 in an individual having, or at risk of having, a disease associated with lipodystrophy syndrome comprises administering a DGAT2 specific inhibitor to the individual, thereby inhibiting expression of DGAT2 in the individual. In certain aspects, administering the inhibitor inhibits expression of DGAT2 in the liver. In certain aspects, administering the inhibitor inhibits expression of DGAT2 in adipose tissue. In certain aspects, the individual has, or is at risk of having lipodystrophy syndrome, partial lipodystrophy, liver steatosis, NAFLD, or NASH. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide.

In certain embodiments, a method of reducing or inhibiting triglyceride synthesis, hepatic lipid synthesis and insulin resistance in the liver of an individual having, or at risk of having, a disease associated with DGAT2 comprises administering a DGAT2 specific inhibitor to the individual, thereby reducing or inhibiting triglyceride synthesis, hepatic lipid synthesis and insulin resistance in the liver of the individual. In certain embodiments, a method of reducing or inhibiting triglyceride synthesis, lipid synthesis and insulin resistance in the adipose tissue of an individual having, or at risk of having, a disease associated with DGAT2 comprises administering a DGAT2 specific inhibitor to the individual, thereby reducing or inhibiting triglyceride synthesis, lipid synthesis and insulin resistance in the adipose tissue of the individual. In certain aspects, administering the DGAT2 inhibitor leads to improvement in hepatic insulin signaling, hepatic insulin sensitivity and cardiovascular risk profile. In certain aspects, administering the DGAT2 specific inhibitor results in reduction in liver steatosis and fibrosis. In certain aspects, administering the DGAT2 specific inhibitor results in improvements in ALT levels. In certain aspects, administering the DGAT2 specific inhibitor results in decrease in NAFLD Activity Score (NAS). In certain aspects, administering the DGAT2 specific inhibitor results in reduction in serum total cholesterol and triglycerides. In certain aspects, administering the DGAT2 specific inhibitor results in neutral insulin sensitivity and glycemic control. In certain aspects, administering the antisense compound results in improved insulin sensitivity and glycemic control. In certain aspects, the individual has, or is at risk of having, NAFLD or NASH. In certain aspects, the individual has, or is at risk of having, lipodystrophy syndrome or partial lipodystrophy. In certain aspects, the inhibitor is an antisense compound targeted to DGAT2. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide. In certain aspects, the antisense compound is administered to the individual parenterally.

Certain embodiments are drawn to a DGAT2 specific inhibitor for use in treating a disease associated with NAFLD. In certain aspects, the disease is NASH. In certain aspects, the disease is hepatic steatosis. In certain aspects, the disease is liver cirrhosis. In certain aspects, the disease is hepatocellular carcinoma. Certain embodiments are drawn to a DGAT2 specific inhibitor for use in treating a disease associated with lipodystrophy syndromes. In certain aspects, the disease is partial lipodystrophy. In certain aspects, the inhibitor is an antisense compound targeted to DGAT2. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide. In certain aspects, the antisense compound is administered to the individual parenterally.

Certain embodiments are drawn to a DGAT2 specific inhibitor for reducing or inhibiting triglyceride synthesis, hepatic lipid synthesis and insulin resistance in the liver of an individual having, or at risk of having, a disease associated with NAFLD or lipodystrophy syndromes comprises administering a DGAT2 specific inhibitor to the individual, thereby reducing or inhibiting triglyceride synthesis, hepatic lipid synthesis and insulin resistance in the liver of the individual. Certain embodiments are drawn to a DGAT2 specific inhibitor for reducing or inhibiting triglyceride synthesis, lipid synthesis and insulin resistance in the adipose tissue of an individual having, or at risk of having, a disease associated with NAFLD or lipodystrophy syndromes comprises administering a DGAT2 specific inhibitor to the individual, thereby reducing or inhibiting triglyceride synthesis, lipid synthesis and insulin resistance in the adipose tissue of the individual. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide.

Certain embodiments are drawn to use of a DGAT2 specific inhibitor for the manufacture of a medicament for treating a disease associated with NAFLD. In certain aspects, the disease is NASH. In certain aspects, the disease is hepatic steatosis. In certain aspects, the disease is liver cirrhosis. In certain aspects, the disease is hepatocellular carcinoma. Certain embodiments are drawn to use of a DGAT2 specific inhibitor for the manufacture of a medicament for treating a disease associated with lipodystrophy syndromes. In certain aspects, the disease is partial lipodystrophy. In certain aspects, the inhibitor is an antisense compound targeted to DGAT2. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide. In certain aspects, the antisense compound is administered to the individual parenterally.

Certain embodiments are drawn to use of a DGAT2 specific inhibitor for the manufacture of a medicament for reducing or inhibiting triglyceride synthesis, hepatic lipid synthesis and insulin resistance in the liver of an individual having, or at risk of having, a disease associated with NAFLD or lipodystrophy syndromes. Certain embodiments are drawn to use of a DGAT2 specific inhibitor for the manufacture of a medicament for reducing or inhibiting triglyceride synthesis, hepatic lipid synthesis and insulin resistance in the liver of an individual having, or at risk of having, a disease associated with NAFLD or lipodystrophy syndromes. Certain embodiments are drawn to use of a DGAT2 specific inhibitor for the manufacture of a medicament for reducing or inhibiting triglyceride synthesis, lipid synthesis and insulin resistance in the adipose tissue of an individual having, or at risk of having, a disease associated with NAFLD or lipodystrophy syndromes. Certain embodiments are drawn to use of a DGAT2 specific inhibitor for the manufacture of a medicament for reducing or inhibiting triglyceride synthesis, lipid synthesis and insulin resistance in the adipose tissue of an individual having, or at risk of having, a disease associated with NAFLD or lipodystrophy syndromes. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide.

In certain embodiments, a method of inhibiting expression of DGAT2 in a cell comprises contacting the cell with a DGAT2 specific inhibitor. In certain embodiments, the cell is a hepatocyte. In certain embodiments, the cell is in the liver of an individual. In certain embodiments, the cell is an adipose tissue cell of an individual. In certain embodiments, the cell is in the adipose tissue of an individual. In certain embodiments, the DGAT2 specific inhibitor is an antisense compound targeted to DGAT2, such as an antisense oligonucleotide targeted to DGAT2. In certain embodiments, the DGAT2 specific inhibitor is a compound comprising or consisting of a modified oligonucleotide and a conjugate group, wherein the modified oligonucleotide consists of 10 to 30 linked nucleosides and has a nucleobase sequence comprising the nucleobase sequence of any one of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising at least 8 contiguous nucleobases of any of the nucleobase sequences of SEQ ID NOs: 16-4679. In certain embodiments, the DGAT2 specific inhibitor is an antisense compound comprising a modified oligonucleotide consisting of 10 to 30 linked nucleosides and having a nucleobase sequence comprising the nucleobase sequence of any one of SEQ ID NOs: 16-4679. In certain embodiments, the DGAT2 specific inhibitor is an antisense compound comprising a modified oligonucleotide consisting of the nucleobase sequence of any one of SEQ ID NOs: 16-4679. In certain embodiments, the DGAT2 specific inhibitor is an antisense compound comprising a modified oligonucleotide consisting of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising or consisting of a modified oligonucleotide and a conjugate group, wherein the modified oligonucleotide consists of 10 to 30 linked nucleosides having a nucleobase sequence comprising any one of SEQ ID NOs: 1423, 1371, 1415, 1849, 2959, 3292, 4198, and 4373. In certain embodiments, the DGAT2 specific inhibitor is an antisense compound comprising a modified oligonucleotide having a nucleobase sequence consisting of any one of SEQ ID NOs: 1423, 1371, 1415, 1849, 2959, 3292, 4198, and 4373. In certain embodiments, the DGAT2 specific inhibitor is ISIS 484137, ISIS 484085, ISIS 484129, ISIS 495576, ISIS 501861, ISIS 502194, ISIS 525443, and ISIS 525612. In certain embodiments the DGAT2 specific inhibitor is ISIS 769355, ISIS 769356, and ISIS 769357. In any of the foregoing embodiments, the antisense compound can be a single-stranded oligonucleotide. In certain aspects, the antisense compound is administered to the individual parenterally.

In any of the foregoing embodiments, the DGAT2 specific inhibitor can be an antisense compound targeted to DGAT2. In certain aspects, the antisense compound is an antisense oligonucleotide, for example an antisense oligonucleotide consisting of 8 to 80 linked nucleosides, 12 to 30 linked nucleosides, or 20 linked nucleosides. In certain aspects, the antisense oligonucleotide is at least 80%, 85%, 90%, 95% or 100% complementary to any of the nucleobase sequences recited in SEQ ID NOs: 1-4. In certain aspects, the antisense oligonucleotide comprises at least one modified internucleoside linkage, at least one modified sugar and/or at least one modified nucleobase. In certain aspects, the modified internucleoside linkage is a phosphorothioate internucleoside linkage, the modified sugar is a bicyclic sugar or a 2'—O-methoxyethyl, and the modified nucleobase is a 5-methylcytosine. In certain aspects, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing embodiments, the antisense oligonucleotide consists of 12 to 30, 15 to 30, 15 to 25, 15 to 24, 16 to 24, 17 to 24, 18 to 24, 19 to 24, 20 to 24, 19 to 22, 20 to 22, 16 to 20, or 17 or 20 linked nucleosides. In certain aspects, the antisense oligonucleotide is at least 80%, 85%, 90%, 95% or 100% complementary to any of the nucleobase sequences recited in SEQ ID NOs: 1-4. In certain aspects, the antisense oligonucleotide comprises at least one modified internucleoside linkage, at least one modified sugar and/or at least one modified nucleobase. In certain aspects, the modified internucleoside linkage is a phosphorothioate internucleoside linkage, the modified sugar is a bicyclic sugar or a 2'—O-methoxyethyl, and the modified nucleobase is a 5-methylcytosine. In certain aspects, the modified oligonucleotide comprises a gap segment consisting of linked 2'-deoxynucleosides; a 5' wing segment consisting of linked nucleosides; and a 3' wing segment consisting of linked nucleosides, wherein the gap segment is positioned immediately adjacent to and between the 5' wing segment and the 3' wing segment and wherein each nucleoside of each wing segment comprises a modified sugar.

In any of the foregoing methods or uses, the DGAT2 specific inhibitor can be a compound comprising or consisting of a modified oligonucleotide consisting of 10 to 30 linked nucleosides having a nucleobase sequence comprising any one of SEQ ID NOs: 16-4679, wherein the modified oligonucleotide comprises:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar.

In any of the foregoing methods or uses, the DGAT2 specific inhibitor can be a compound comprising a conjugate group and a modified oligonucleotide consisting of 10 to 30 linked nucleosides having a nucleobase sequence comprising any one of SEQ ID NOs: 16-4679, wherein the modified oligonucleotide comprises:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar.

In any of the foregoing methods or uses, the DGAT2 specific inhibitor can be a compound comprising or consisting of a modified oligonucleotide consisting of 10 to 30 linked nucleosides having a nucleobase sequence comprising any one of SEQ ID NOs: 1423, 1371, 1415, 1849, 2959, 3292, 4198, or 4373, wherein the modified oligonucleotide comprises:
  a gap segment consisting of linked 2'-deoxynucleosides;
  a 5' wing segment consisting of linked nucleosides; and
  a 3' wing segment consisting of linked nucleosides;
  wherein the gap segment is positioned between the 5' wing segment and the 3' wing segment and wherein each nucleoside of each wing segment comprises a modified sugar.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 1423, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 1423, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising a conjugate group and a modified oligonucleotide consisting of 20 linked nucleosides having a nucleobase sequence consisting of the sequence recited in SEQ ID NO: 1423, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 1371, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 1371, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 1415, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 1415, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 1849, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
  wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 1849, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 2959, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 2959, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 16 to 30 linked nucleosides having a nucleobase sequence comprising the sequence recited in SEQ ID NO: 3292, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 20 linked nucleosides having a nucleobase sequence consisting of the sequence recited in SEQ ID NO: 3292, wherein the modified oligonucleotide comprises:
  a gap segment consisting of ten linked 2'-deoxynucleosides;
  a 5' wing segment consisting of five linked nucleosides; and
  a 3' wing segment consisting of five linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 14 to 30 linked nucleosides having a nucleobase sequence comprising the sequence recited in SEQ ID NO: 4198, wherein the modified oligonucleotide comprises:
  a gap segment consisting of ten linked 2'-deoxynucleosides;
  a 5' wing segment consisting of three linked nucleosides; and
  a 3' wing segment consisting of four linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 17 linked nucleosides having a nucleobase sequence consisting of the sequence recited in SEQ ID NO: 4198, wherein the modified oligonucleotide comprises:
  a gap segment consisting of ten linked 2'-deoxynucleosides;
  a 5' wing segment consisting of three linked nucleosides; and
  a 3' wing segment consisting of four linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 14 to 30 linked nucleosides having a nucleobase sequence comprising the sequence recited in SEQ ID NO: 4373, wherein the modified oligonucleotide comprises:
  a gap segment consisting of ten linked 2'-deoxynucleosides;
  a 5' wing segment consisting of three linked nucleosides; and
  a 3' wing segment consisting of four linked nucleosides;
    wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor can be a compound comprising or consisting of a modified oligonucleotide consisting of 17 linked nucleosides having a nucleobase sequence consisting of the sequence recited in SEQ ID NO: 4373, wherein the modified oligonucleotide comprises:

a gap segment consisting of ten linked 2'-deoxynucleosides;

a 5' wing segment consisting of three linked nucleosides; and a 3' wing segment consisting of four linked nucleosides; wherein the gap segment is positioned between the 5' wing segment and the 3' wing segment; wherein each nucleoside of each wing segment comprises a 2'MOE sugar; wherein each internucleoside linkage is a phosphorothioate linkage; and wherein each cytosine is a 5-methylcytosine.

In any of the foregoing methods or uses, the DGAT2 specific inhibitor is administered subcutaneously, such as by subcutaneous injection.

Antisense Compounds

Oligomeric compounds include, but are not limited to, oligonucleotides, oligonucleosides, oligonucleotide analogs, antisense compounds, antisense oligonucleotides, and siRNAs. An oligomeric compound may be "antisense" to a target nucleic acid, meaning that is is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted.

In certain embodiments, an antisense compound is 10 to 30 subunits in length. In certain embodiments, an antisense compound is 12 to 30 subunits in length. In certain embodiments, an antisense compound is 12 to 22 subunits in length. In certain embodiments, an antisense compound is 14 to 30 subunits in length. In certain embodiments, an antisense compound is 14 to 20 subunits in length. In certain embodiments, an antisense compound is 15 to 30 subunits in length. In certain embodiments, an antisense compound is 15 to 20 subunits in length. In certain embodiments, an antisense compound is 16 to 30 subunits in length. In certain embodiments, an antisense compound is 16 to 20 subunits in length. In certain embodiments, an antisense compound is 17 to 30 subunits in length. In certain embodiments, an antisense compound is 17 to 20 subunits in length. In certain embodiments, an antisense compound is 18 to 30 subunits in length. In certain embodiments, an antisense compound is 18 to 21 subunits in length. In certain embodiments, an antisense compound is 18 to 20 subunits in length. In certain embodiments, an antisense compound is 20 to 30 subunits in length. In other words, such antisense compounds are from 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, an antisense compound is 14 subunits in length. In certain embodiments, an antisense compound is 16 subunits in length. In certain embodiments, an antisense compound is 17 subunits in length. In certain embodiments, an antisense compound is 18 subunits in length. In certain embodiments, an antisense compound is 19 subunits in length. In certain embodiments, an antisense compound is 20 subunits in length. In other embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the antisense compound is an antisense oligonucleotide, and the linked subunits are nucleotides, nucleosides, or nucleobases.

In certain embodiments, the antisense compound or oligomeric compound may further comprise additional features or elements, such as a conjugate group, that are attached to the oligonucleotide. In embodiments where a conjugate group comprises a nucleoside (i.e. a nucleoside that links the conjugate group to the oligonucleotide), the nucleoside of the conjugate group is not counted in the length of the oligonucleotide.

In certain embodiments antisense oligonucleotides may be shortened or truncated. For example, a single nucleoside may be deleted from the 5' end (5' truncation), or alternatively from the 3' end (3' truncation). A shortened or truncated antisense compound targeted to an DGAT2 nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity (Woolf et al. (Proc. Natl. Acad. Sci. USA 89:7305-7309, 1992; Gautschi et al. *J. Natl. Cancer Inst.* 93:463-471, March 2001; Maher and Dolnick *Nuc. Acid. Res.* 16:3341-3358, 1988). However, seemingly small changes in oligonucleotide sequence, chemistry and motif can make large differences in one or more of the many properties required for clinical development (Seth et al. *J. Med. Chem.* 2009, 52, 10; Egli et al. *J. Am. Chem. Soc.* 2011, 133, 16642).

In certain embodiments, antisense compounds are single-stranded, consisting of one oligomeric compound. The oligonucleotide of such single-stranded antisense compounds is an antisense oligonucleotide. In certain embodiments, the antisense oligonucleotide of a single-stranded antisense compound is modified. In certain embodiments, the oligonucleotide of a single-stranded antisense compound or oligomeric compound comprises a self-complementary nucleobase sequence. In certain embodiments, antisense compounds are double-stranded, comprising two oligomeric compounds that form a duplex. In certain such embodiments, one oligomeric compound of a double-stranded antisense compound comprises one or more conjugate groups. In certain embodiments, each oligomeric compound of a double-stranded antisense compound comprises one or more conjugate groups. In certain embodiments, each oligonucleotide of a double-stranded antisense compound is a modified oligonucleotide. In certain embodiments, one oligonucleotide of a double-stranded antisense compound is a modified oligonucleotide. In certain embodiments, one oligonucleotide of a double-stranded antisense compound is an antisense oligonucleotide. In certain such embodiments, the antisense oligonucleotide is a modified oligonucleotide. Examples of single-stranded and double-stranded antisense compounds include but are not limited to antisense oligonucleotides, siRNAs, microRNA targeting oligonucleotides, and single-stranded RNAi compounds, such as small hairpin RNAs (shRNAs), single-stranded siRNAs (ssRNAs), and microRNA mimics.

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics.

In certain embodiments, a double-stranded compound can comprise any of the oligonucleotide sequences targeted to DGAT2 described herein. In certain embodiments, a double-stranded compound comprises a first strand comprising at least an 8, 9, 10, 11, 12, 13, 14, 15, 16, 17, 18, 19, or 20 contiguous nucleobase portion of any one of SEQ ID NOs: 16-4679 and a second strand. In certain embodiments, a double-stranded compound comprises a first strand comprising the nucleobase sequence of any one of SEQ ID NOs: 16-4679 and a second strand. In certain embodiments, the double-stranded compound comprises ribonucleotides in which the first strand has uracil (U) in place of thymine (T) in any one of SEQ ID NOs: 16-4679. In certain embodiments, a double-stranded compound comprises (i) a first strand comprising a nucleobase sequence complementary to the site on DGAT2 to which any of SEQ ID NOs: 16-4679 is targeted, and (ii) a second strand. In certain embodiments, the double-stranded compound comprises one or more modified nucleotides in which the 2' position in the sugar contains a halogen (such as fluorine group; 2'-F) or contains an alkoxy group (such as a methoxy group; 2'—OMe). In certain embodiments, the double-stranded compound comprises at least one 2'-F sugar modification and at least one 2'—OMe sugar modification. In certain embodiments, the at least one 2'-F sugar modification and at least one 2'—OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the dsRNA compound. In certain embodiments, the double-stranded compound comprises one or more linkages between adjacent nucleotides other than a naturally-occurring phosphodiester linkage. Examples of such linkages include phosphoramide, phosphorothioate, and phosphorodithioate linkages. The double-stranded compounds may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000. In certain embodiments, the first strand of the double-stranded compound is an siRNA guide strand and the second strand of the double-stranded compound is an siRNA passenger strand. In certain embodiments, the second strand of the double-stranded compound is complementary to the first strand. In certain embodiments, each strand of the double-stranded compound consists of 16, 17, 18, 19, 20, 21, 22, or 23 linked nucleosides. In certain embodiments, the first or second strand of the double-stranded compound can comprise a conjugate group.

In certain embodiments, a single-stranded RNAi (ssRNAi) compound can comprise any of the oligonucleotide sequences targeted to DGAT2 described herein. In certain embodiments, an ssRNAi compound comprises at least an 8, 9, 10, 11, 12, 13, 14, 15, 16, 17, 18, 19, or 20 contiguous nucleobase portion of any one of SEQ ID NOs: 16-4679. In certain embodiments, an ssRNAi compound comprises the nucleobase sequence of any one of SEQ ID NOs: 16-4679. In certain embodiments, the ssRNAi compound comprises ribonucleotides in which uracil (U) is in place of thymine (T) in any one of SEQ ID NOs: 16-4679. In certain embodiments, an ssRNAi compound comprises a nucleobase sequence complementary to the site on DGAT2 to which any of SEQ ID NOs: 16-4679 is targeted. In certain embodiments, an ssRNAi compound comprises one or more modified nucleotides in which the 2' position in the sugar contains a halogen (such as fluorine group; 2'-F) or contains an alkoxy group (such as a methoxy group; 2'—OMe). In certain embodiments, an ssRNAi compound comprises at least one 2'-F sugar modification and at least one 2'—OMe sugar modification. In certain embodiments, the at least one 2'-F sugar modification and at least one 2'—OMe sugar modification are arranged in an alternating pattern for at least 2, 3, 4, 5, 6, 7, 8, 9, 10, 11, 12, 13, 14, 15, 16, 17, 18, 19, or 20 contiguous nucleobases along a strand of the ssRNAi compound. In certain embodiments, the ssRNAi compound comprises one or more linkages between adjacent nucleotides other than a naturally-occurring phosphodiester linkage. Examples of such linkages include phosphoramide, phosphorothioate, and phosphorodithioate linkages. The ssRNAi compounds may also be chemically modified nucleic acid molecules as taught in U.S. Pat. No. 6,673,661. In other embodiments, the ssRNAi contains a capped strand, as disclosed, for example, by WO 00/63364, filed Apr. 19, 2000. In certain embodiments, the ssRNAi compound consists of 16, 17, 18, 19, 20, 21, 22, or 23 linked nucleosides. In certain embodiments, the ssRNAi compound can comprise a conjugate group.

In certain embodiments, antisense compounds comprise modified oligonucleotides. Certain modified oligonucleotides have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L) such as for amino acids etc. Included in the modified oligonucleotides provided herein are all such possible isomers, including their racemic and optically pure forms, unless specified otherwise. Likewise, all cis- and trans-isomers and tautomeric forms are also included.

In certain embodiments, antisense compounds and oligomeric compounds described herein comprise modified oligonucleotides. Such modified oligonucleotides may contain any combination of the modified sugar moieites, modified nucleobases, modified internucleoside linkages, motifs, and/or lengths described herein.

Certain Antisense Compound Mechanisms

In certain embodiments, antisense compounds are capable of hybridizing to a target nucleic acid, resulting in at least one antisense activity. In certain embodiments, antisense compounds specifically affect one or more target nucleic acid. Such specific antisense compounds comprises a nucleobase sequence that hybridizes to one or more target nucleic acid, resulting in one or more desired antisense activity and does not hybridize to one or more non-target nucleic acid or does not hybridize to one or more non-target nucleic acid in such a way that results in an undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, the invention provides antisense compounds that are sufficiently "DNA-like" to elicit RNase H activity. Further, in certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. In certain embodiments, antisense compounds that are loaded into RISC are RNAi compounds.

In certain embodiments, hybridization of an antisense compound to a target nucleic acid dose not result in recruitment of a protein that cleaves that target nucleic acid. In certain such embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain such embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein, and/or a phenotypic change in a cell or animal.

In certain embodiments, modified oligonucleotides having a gapmer sugar motif described herein have desirable properties compared to non-gapmer oligonucleotides or to gapmers having other sugar motifs. In certain circumstances, it is desirable to identify motifs resulting in a favorable combination of potent antisense activity and relatively low toxicity. In certain embodiments, compounds of the present invention have a favorable therapeutic index (measure of activity divided by measure of toxicity).

Target Nucleic Acids, Target Regions and Nucleotide Sequences

In certain embodiments, antisense compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: an mRNA and a pre-mRNA, including intronic, exonic and untranslated regions. In certain embodiments, the target RNA is an mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron.

Nucleotide sequences that encode DGAT2 include, without limitation, the following: RefSeq No. NM_032564.3 (incorporated herein by reference; designated herein as SEQ ID NO: 1), nucleotides 5669186 to 5712008 of RefSeq No. NT_033927.5 (incorporated herein by reference; designated herein as SEQ ID NO: 2), nucleotides 20780400 to 20823450 of RefSeq No. NT_167190.1 (incorporated herein by reference; designated herein as SEQ ID NO: 4878), RefSeq No. AK091870.1 (incorporated herein by reference; designated herein as SEQ ID NO: 4879), and nucleotides 1232000 to 1268000 of RefSeq No. NW_001100387.1 (incorporated herein by reference; designated herein as SEQ ID NO: 3).

Hybridization

In some embodiments, hybridization occurs between an antisense compound disclosed herein and a DGAT2 nucleic acid. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Hybridization conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with a DGAT2 nucleic acid.

Complementarity

An oligonucleotide is said to be complementary to another nucleic acid when the nucleobase sequence of such oligonucleotide or one or more regions thereof matches the nucleobase sequence of another oligonucleotide or nucleic acid or one or more regions thereof when the two nucleobase sequences are aligned in opposing directions. Nucleobase matches or complementary nucleobases, as described herein, are limited to adenine (A) and thymine (T), adenine (A) and uracil (U), cytosine (C) and guanine (G), and 5-methyl cytosine (mC) and guanine (G) unless otherwise specified. Complementary oligonucleotides and/or nucleic acids need not have nucleobase complementarity at each nucleoside and may include one or more nucleobase mismatches. An oligonucleotide is fully complementary or 100% complementary when such oligonucleotides have nucleobase matches at each nucleoside without any nucleobase mismatches.

Non-complementary nucleobases between an antisense compound and a DGAT2 nucleic acid may be tolerated provided that the antisense compound remains able to specifically hybridize to a target nucleic acid. Moreover, an antisense compound may hybridize over one or more segments of a DGAT2 nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a DGAT2 nucleic acid, a target region, target segment, or specified portion thereof. In certain such embodiments, the region of full complementarity is from 6 to 20 nucleobases in length. In certain such embodiments, the region of full complementarity is from 10 to 18 nucleobases in length. In certain such embodiments, the region of full complementarity is from 18 to 20 nucleobases in length. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a DGAT2 nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

In certain embodiments, antisense compounds comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the antisense compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds comprise one or more mismatched nucleobases relative to the target nucleic acid. In certain such embodiments, antisense activity against the target is reduced by such mismatch, but activity against a non-target is reduced by a greater amount. Thus, in certain such embodiments selectivity of the antisense compound is improved. In certain embodiments, the mismatch is specifically positioned within an oligonucleotide having a gapmer motif. In certain such embodiments, the mismatch is at position 1, 2, 3, 4, 5, 6, 7, or 8 from the 5'-end of the gap region. In certain such embodiments, the mismatch is at position 9, 8, 7, 6, 5, 4, 3, 2, 1 from the 3'-end of the gap region. In certain such embodiments, the mismatch is at position 1, 2, 3, or 4 from the 5'-end of the wing region. In certain such embodiments, the mismatch is at position 4, 3, 2, or 1 from the 3'-end of the wing region.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a DGAT2 nucleic acid, or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a DGAT2 nucleic acid, or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are, or are at least, 70%, 75%, 80%, 85%, 90%, 91%, 92%, 93%, 94%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino (—CH$_2$—N(CH$_3$)—O—CH$_2$—), thiodiester (—O—C(=O)—S—), thionocarbamate (—O—C(=O)(NH)—S—); siloxane (—O—SiH$_2$—O—); and N,N'-dimethylhydrazine (—CH$_2$—N(CH$_3$)—N(CH$_3$)—). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Representative chiral internucleoside linkages include but are not limited to alkylphosphonates and phosphorothioates. Methods of preparation of phosphorous-containing and non-phosphorous-containing internucleoside linkages are well known to those skilled in the art.

Neutral internucleoside linkages include, without limitation, phosphotriesters, methylphosphonates, MMI (3'—CH$_2$—N(CH$_3$)—O-5'), amide-3 (3'—CH$_2$—C(=O)—N(H)-5'), amide-4 (3'—CH$_2$—N(H)—C(=O)-5'), formacetal (3'—O—CH$_2$—O-5), methoxypropyl, and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

In certain embodiments, antisense compounds targeted to a DGAT2 nucleic acid comprise one or more modified internucleoside linkages. In certain embodiments, the modified internucleoside linkages are phosphorothioate linkages.

In certain embodiments, each internucleoside linkage of an antisense compound is a phosphorothioate internucleoside linkage.

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The nucleoside motif is independently selected, so such oligonucleotides having a gapped internucleoside linkage motif may or may not have a gapped nucleoside motif and if it does have a gapped nucleoside motif, the wing and gap lengths may or may not be the same.

In certain embodiments, oligonucleotides comprise a region having an alternating internucleoside linkage motif. In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

In certain embodiments, oligonucleotides comprise one or more methylphosponate linkages. In certain embodiments, oligonucleotides having a gapmer nucleoside motif comprise a linkage motif comprising all phosphorothioate linkages except for one or two methylphosponate linkages. In certain embodiments, one methylphosponate linkage is in the central gap of an oligonucleotide having a gapmer nucleoside motif.

In certain embodiments, it is desirable to arrange the number of phosphorothioate internucleoside linkages and phosphodiester internucleoside linkages to maintain nuclease resistance. In certain embodiments, it is desirable to arrange the number and position of phosphorothioate internucleoside linkages and the number and position of phosphodiester internucleoside linkages to maintain nuclease resistance. In certain embodiments, the number of phosphorothioate internucleoside linkages may be decreased and the number of phosphodiester internucleoside linkages may be increased. In certain embodiments, the number of phosphorothioate internucleoside linkages may be decreased and the number of phosphodiester internucleoside linkages may be increased while still maintaining nuclease resistance. In certain embodiments it is desirable to decrease the number of phosphorothioate internucleoside linkages while retaining nuclease resistance. In certain embodiments it is desirable to increase the number of phosphodiester internucleoside linkages while retaining nuclease resistance.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds.

In certain embodiments, modified oligonucleotides comprise one or more modified nucleosides comprising a modified sugar moiety. Such modified oligonucleotides comprising one or more sugar-modified nucleosides may have desirable properties, such as enhanced nuclease stability or increased binding affinity with a target nucleic acid relative to oligonucleotides lacking such sugar-modified nucleosides. In certain embodiments, modified sugar moieties are linearly modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of substituted sugar moieties.

In certain embodiments, modified sugar moieties are linearly modified sugar moieties comprising a furanosyl ring with one or more acyclic substituent, including but not limited to substituents at the 2' and/or 5' positions. Examples of 2'-substituent groups suitable for linearly modified sugar moieties include but are not limited to: 2'-F, 2'—OCH$_3$ ("OMe" or "O-methyl"), and 2'—O(CH$_2$)$_2$OCH$_3$ ("MOE"). In certain embodiments, 2'-substituent groups are selected from among: halo, allyl, amino, azido, SH, CN, OCN, CF$_3$, OCF$_3$, O—C$_1$-C$_{10}$ alkoxy, O—C$_1$-C$_{10}$ substituted alkoxy, O—C$_1$-C$_{10}$ alkyl, O—C$_1$-C$_{10}$ substituted alkyl, S-alkyl, N(R$_m$)-alkyl, O-alkenyl, S-alkenyl, N(R$_m$)-alkenyl, O-alkynyl, S-alkynyl, N(R$_m$)-alkynyl, O-alkylenyl-O-alkyl, alkaryl, aralkyl, O-alkaryl, O-aralkyl, O(CH$_2$)$_2$SCH$_3$, O(CH$_2$)$_2$ON(R$_m$)(R$_n$) or OCH$_2$C(=O)—N(R$_m$)(R$_n$), where each R$_m$ and R$_n$ is, independently, H, an amino protecting group, or substituted or unsubstituted C$_1$-C$_{10}$ alkyl. Certain embodiments of these 2'-substituent groups can be further substituted with one or more substituent groups independently selected from among: hydroxyl, amino, alkoxy, carboxy, benzyl, phenyl, nitro (NO$_2$), thiol, thioalkoxy, thioalkyl, halogen, alkyl, aryl, alkenyl and alkynyl. Examples of 5'-substituent groups suitable for linearly modified sugar moieties include but are not limited to: 5'-methyl (R or S), 5'-vinyl, and 5'-methoxy. In certain embodiments, linearly modified sugars comprise more than one non-bridging sugar substituent, for example, 2'-F-5'-methyl sugar moieties (see, e.g., PCT International Application WO 2008/101157, for additional 2', 5'-bis substituted sugar moieties and nucleosides).

In certain embodiments, a 2'-substituted nucleoside or 2'-linearly modified nucleoside comprises a sugar moiety comprising a linear 2'-substituent group selected from: F, NH$_2$, N$_3$, OCF$_3$, OCH$_3$, O(CH$_2$)$_3$NH$_2$, CH$_2$CH=CH$_2$, OCH$_2$CH=CH$_2$, OCH$_2$CH$_2$OCH$_3$, O(CH$_2$)$_2$SCH$_3$, O $(CH_2)_2ON(R_m)(R_n)$, $O(CH_2)_2O(CH_2)_2N(CH_3)_2$, and N-substituted acetamide $(OCH_2C(=O)-N(R_m)(R_n))$, where each $R_m$ and $R_n$ is, independently, H, an amino protecting group, or substituted or unsubstituted $C_1$-$C_{10}$ alkyl.

In certain embodiments, a 2'-substituted nucleoside or 2'-linearly modified nucleoside comprises a sugar moiety comprising a linear 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)-N(H)CH_3$ ("NMA").

In certain embodiments, a 2'-substituted nucleoside or 2'-linearly modified nucleoside comprises a sugar moiety comprising a linear 2'-substituent group selected from: F, $OCH_3$, and $OCH_2CH_2OCH_3$.

Nucleosides comprising modified sugar moieties, such as linearly modified sugar moieties, are referred to by the position(s) of the substitution(s) on the sugar moiety of the nucleoside. For example, nucleosides comprising 2'-substituted or 2-modified sugar moieties are referred to as 2'-substituted nucleosides or 2-modified nucleosides.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'—$CH_2$-2', 4'—$(CH_2)_2$-2', 4'—$(CH_2)_3$-2', ("LNA"), 4'-$(CH_2)_2$—O-2' ("ENA"), 4'—$CH(CH_3)$—O-2' (referred to as "constrained ethyl" or "cEt" when in the S configuration), 4'—$CH_2$—O—$CH_2$-2', 4'—$CH_2$—N(R)-2', 4'—$CH(CH_2OCH_3)$—O-2' ("constrained MOE" or "cMOE") and analogs thereof (see, e.g., U.S. Pat. No. 7,399,845), 4'-$C(CH_3)(CH_3)$—O-2' and analogs thereof (see, e.g., WO2009/006478), 4'—$CH_2$—N($OCH_3$)—2' and analogs thereof (see, e.g., WO2008/150729), 4'—$CH_2$—O—N($CH_3$)—2' (see, e.g., US2004/0171570), 4'—$CH_2$—C(H)($CH_3$)—2' (see, e.g., Chattopadhyaya, et al., *J. Org. Chem.*, 2009, 74, 118-134), 4'—$CH_2$—C(=$CH_2$)-2' and analogs thereof (see, published PCT International Application WO 2008/154401), 4'-C($R_aR_b$)—N(R)—O-2', 4'—C($R_aR_b$)—O—N(R)-2', 4'—$CH_2$—O—N(R)-2', and 4'—$CH_2$—N(R)—O-2', wherein each R, $R_a$, and $R_b$ is, independently, H, a protecting group, or $C_1$-$C_{12}$ alkyl (see, e.g. U.S. Pat. No. 7,427,672).

In certain embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$)=C($R_b$)—, —C($R_a$)=N—, —C(=N$R_a$)—, —C(=O)—, —C(=S)—, —O—, —Si($R_a$)$_2$—, —S(=O)$_x$—, and —N($R_a$)—;

wherein:
x is 0, 1, or 2;
n is 1, 2, 3, or 4;
each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, for example: Freier et al., *Nucleic Acids Research*, 1997, 25(22), 4429-4443, Albaek et al., *J. Org. Chem.*, 2006, 71, 7731-7740, Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 20017, 129, 8362-8379; Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; U.S. Pat. Nos. 7,053,207, 6,268,490, 6,770,748, 6,794,499, 7,034,133, 6,525,191, 6,670,461, and 7,399,845; WO 2004/106356, WO 1994/14226, WO 2005/021570, and WO 2007/134181; U.S. Patent Publication Nos. US2004/0171570, US2007/0287831, and US2008/0039618; U.S. patent Ser. No. 12/129,154, 60/989,574, 61/026,995, 61/026,998, 61/056,564, 61/086,231, 61/097,787, and 61/099,844; and PCT International Applications Nos. PCT/US2008/064591, PCT/US2008/066154, and PCT/US2008/068922.

In certain embodiments, bicyclic sugar moieties and nucleosides incorporating such bicyclic sugar moieties are further defined by isomeric configuration. For example, an LNA nucleoside (described above) may be in the α-L configuration or in the β-D configuration.

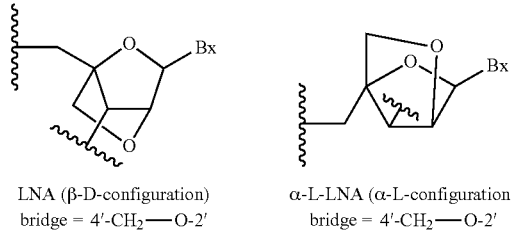

LNA (β-D-configuration)
bridge = 4'-$CH_2$—O-2'

α-L-LNA (α-L-configuration)
bridge = 4'-$CH_2$—O-2'

α-L-methyleneoxy (4'—$CH_2$—O-2') or α-L-LNA bicyclic nucleosides have been incorporated into antisense oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars). (see, e.g., WO 2007/134181, wherein LNA nucleosides are further substituted with, for example, a 5'-methyl or a 5'-vinyl group, and see, e.g., U.S. Pat. Nos. 7,547,684; 7,750,131; 8,030,467; 8,268,980; 7,666, 854; and 8,088,746).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described above. For example, certain sugar surrogates comprise a 4'-sulfur atom and a substitution at the 2'-position (see, e.g., US2005/0130923) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see Leumann, C J. *Bioorg. & Med. Chem.* 2002, 10, 841-854), fluoro HNA:

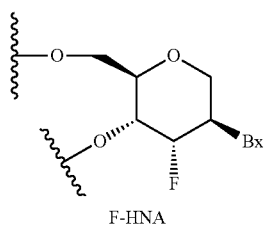

F-HNA ("F-HNA", see e.g., U.S. Pat. Nos. 8,088,904; 8,440,803; and 8,796,437, F-HNA can also be referred to as a F-THP or 3'-fluoro tetrahydropyran), and nucleosides comprising additional modified THP compounds having the formula:

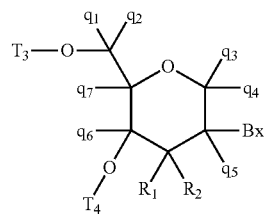

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group; $q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and U.S. Pat. Nos. 5,698,685; 5,166,315; 5,185,444; and 5,034,506). As used here, the term "morpholino" means a sugar surrogate having the following structure:

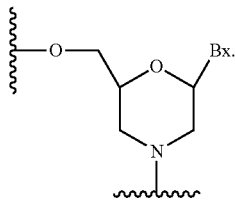

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieites. Examples of nucleosides and oligonucleotieds comprising such acyclic sugar surrogates include but are not limited to: peptide nucleic acid ("PNA"), acyclic butyl nucleic acid (see, e.g., Kumar et al., *Org. Biomol. Chem.*, 2013, 11, 5853-5865), and nucleosides and oligonucleotides described in WO2011/133876.

Many other bicyclic and tricyclic sugar and sugar surrogate ring systems are known in the art that can be used in modified nucleosides (see, e.g., Leumann, J. C, *Bioorganic & Medicinal Chemistry,* 2002, 10, 841-854).

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds.

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl (—C≡C—CH$_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Representative United States patents that teach the preparation of certain of the above noted modified nucleobases as well as other modified nucleobases include without limitation, US2003/0158403, U.S. Pat. Nos. 3,687,808; 4,845, 205; 5,130,302; 5,134,066; 5,175,273; 5,367,066; 5,432, 272; 5,434,257; 5,457,187; 5,459,255; 5,484,908; 5,502, 177; 5,525,711; 5,552,540; 5,587,469; 5,594,121; 5,596, 091; 5,614,617; 5,645,985; 5,681,941; 5,750,692; 5,763, 588; 5,830,653 and 6,005,096.

In certain embodiments, antisense compounds targeted to a DGAT2 nucleic acid comprise one or more modified nucleobases. In certain embodiments, the modified nucleobase is 5-methylcytosine. In certain embodiments, each cytosine is a 5-methylcytosine.

Certain Motifs

Oligonucleotides can have a motif, e.g. a pattern of unmodified and/or modified sugar moieties, nucleobases, and/or internucleoside linkages. In certain embodiments, modified oligonucleotides comprise one or more modified nucleoside comprising a modified sugar. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which comprises two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, the wings of a gapmer comprise 2-5 nucleosides. In certain embodiments, the wings of a gapmer comprise 3-5 nucleosides. In certain embodiments, the nucleosides of a gapmer are all modified nucleosides.

In certain embodiments, the gap of a gapmer comprises 7-12 nucleosides. In certain embodiments, the gap of a gapmer comprises 7-10 nucleosides. In certain embodiments, the gap of a gapmer comprises 8-10 nucleosides. In certain embodiments, the gap of a gapmer comprises 10 nucleosides. In certain embodiment, each nucleoside of the gap of a gapmer is an unmodified 2'-deoxy nucleoside.

In certain embodiments, the gapmer is a deoxy gapmer. In such embodiments, the nucleosides on the gap side of each wing/gap junction are unmodified 2'-deoxy nucleosides and the nucleosides on the wing sides of each wing/gap junction are modified nucleosides. In certain such embodiments, each nucleoside of the gap is an unmodified 2'-deoxy nucleoside. In certain such embodiments, each nucleoside of each wing is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain such embodiments, each nucleoside to the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methylcytosines.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, essentially each internucleoside linking group is a phosphate internucleoside linkage (P=O). In certain embodiments, each internucleoside linking group of a modified oligonucleotide is a phosphorothioate (P=S). In certain embodiments, each internucleoside linking group of a modified oligonucleotide is independently selected from a phosphorothioate and phosphate internucleoside linkage. In certain embodiments, the sugar motif of a modified oligonucleotide is a gapmer and the internucleoside linkages within the gap are all modified. In certain such embodiments, some or all of the internucleoside linkages in the wings are unmodified phosphate linkages. In certain embodiments, the terminal internucleoside linkages are modified.

Certain Oligonucleotides

Oligonucleotides are characterized by their motifs and overall lengths. In certain embodiments, such parameters are each independent of one another. Thus, unless otherwise indicated, each internucleoside linkage of an oligonucleotide having a gapmer motif may be modified or unmodified and may or may not follow the gapmer modification pattern of the sugar modifications. For example, the internucleoside linkages within the wing regions of a gapmer may be the same or different from one another and may be the same or different from the internucleoside linkages of the gap region. Likewise, such gapmer oligonucleotides may comprise one or more modified nucleobase independent of the gapmer pattern of the sugar modifications. Furthermore, unless otherwise indicated, each internucleoside linkage and each nucleobase of a fully modified oligonucleotide may be modified or unmodified. One of skill in the art will appreciate that such motifs may be combined to create a variety of oligonucleotides. Herein, if a description of an oligonucleotide is silent with respect to one or more parameter, such parameter is not limited. Thus, a modified oligonucleotide described only as having a gapmer motif without further description may have any length, internucleoside linkage motif, and nucleobase motif. Unless otherwise indicated, all modifications are independent of nucleobase sequence.

In certain embodiments, oligonucleotides have a nucleobase sequence that is complementary to a second oligonucleotide or a target nucleic acid. In certain such embodiments, a region of an oligonucleotide has a nucleobase sequence that is complementary to a second oligonucleotide or a target nucleic acid. In certain embodiments, the nucleobase sequence of a region or entire length of an oligonucleotide is at least 50%, at least 60%, at least 70%, at least 80%, at least 90%, at least 95%, or 100% complementary to the second oligonucleotide or target nucleic acid. In certain embodiments, antisense compounds comprise two oligomeric compounds, wherein the two oligonucleotides of the oligomeric compounds are at least 80%, at least 90%, or 100% complementary to each other. In certain embodiments, one or both oligonucleotides of a double-stranded antisense compound comprise two nucleosides that are not complementary to the other oligonucleotide.

Conjugated Groups and Terminal Groups

In certain embodiments, antisense compounds and oligomeric compounds comprise conjugate groups and/or terminal groups. In certain such embodiments, oligonucleotides are covalently attached to one or more conjugate group. In certain embodiments, conjugate groups modify one or more properties of the attached oligonucleotide, including but not limited to pharmacodynamics, pharmacokinetics, stability, binding, absorption, cellular distribution, cellular uptake, charge and clearance. In certain embodiments, conjugate groups impart a new property on the attached oligonucleotide, e.g., fluorophores or reporter groups that enable detection of the oligonucleotide. Conjugate groups and/or terminal groups may be added to oligonucleotides having any of the modifications or motifs described above. Thus, for example, an antisense compound or oligomeric compound comprising an oligonucleotide having a gapmer motif may also comprise a conjugate group.

Conjugate groups include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes. Certain conjugate groups have been described previously, for example: cholesterol moiety (Letsinger et al., *Proc. Natl. Acad. Sci. USA,* 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Let.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO 1,* 1991, 10, 1111-1118; Kabanov et al., *FEBS Lett.,* 1990, 259, 327-330; Svinarchuk et al., *Biochimie,* 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid (Manoharan et al., *Tetrahedron Lett.,* 1995, 36, 3651-3654), a palmityl moiety (Mishra et al., *Biochim. Biophys. Acta,* 1995, 1264, 229-237), an octadecylamine or hexylamino-carbonyl-oxycholesterol moiety (Crooke et al., *I Pharmacol. Exp. Ther.,* 1996, 277, 923-937), a tocopherol group (Nishina et al., *Molecular Therapy Nucleic Acids,* 2015, 4, e220; doi:10.1038/mtna.2014.72 and Nishina et al., *Molecular Therapy,* 2008, 16, 734-740), or a GalNAc cluster (e.g., WO2014/179620).

In certain embodiments, a conjugate group comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

Conjugate groups are attached directly or via an optional conjugate linker to a parent compound, such as an oligonucleotide. In certain embodiments, conjugate groups are directly attached to oligonucleotides. In certain embodiments, conjugate groups are indirectly attached to oligonucleotides via conjugate linkers. In certain embodiments, the conjugate linker comprises a chain structure, such as a hydrocarbyl chain, or an oligomer of repeating units such as ethylene glycol or amino acid units. In certain embodiments, conjugate groups comprise a cleavable moiety. In certain embodiments, conjugate groups are attached to oligonucleotides via a cleavable moiety. In certain embodiments, conjugate linkers comprise a cleavable moiety. In certain such embodiments, conjugate linkers are attached to oligonucleotides via a cleavable moiety. In certain embodiments, oligonucleotides comprise a cleavable moiety, wherein the cleavable moiety is a nucleoside is attached to a cleavable internucleoside linkage, such as a phosphate internucleoside linakge. In certain embodiments, a conjugate group comprises a nucleoside or oligonucleotide, wherein the nucleoside or oligonucleotide of the conjugate group is indirectly attached to a parent oligonucleotide.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, a cleavable moiety is a cleavable bond. In certain embodiments, a cleavable moiety comprises a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate linker or conjugate group.

In certain embodiments, a cleavable moiety is a nucleoside. In certain such embodiments, the unmodified or modified nucleoside comprises an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methylcytosine, 4-N-benzoyl-5-methylcytosine, adenine, 6-N-benzoyladenine, guanine and 2-N-isobutyrylguanine. In certain embodiments, a cleavable moiety is 2'-deoxy nucleoside that is attached to either the 3' or 5'-terminal nucleoside of an oligonucleotide by a phosphate internucleoside linkage and covalently attached to the conjugate linker or conjugate group by a phosphate or phosphorothioate linkage. In certain such embodiments, the cleavable moiety is 2'-deoxyadenosine.

Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

In certain embodiments, a conjugate group is a cell-targeting moiety. In certain embodiments, a conjugate group, optional conjugate linker, and optional cleavable moiety have the general formula:

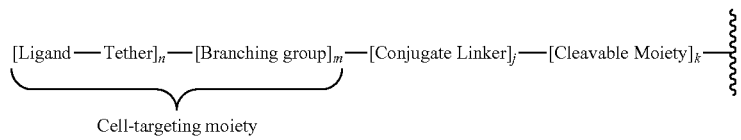

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group. In certain embodiments, cell-targeting moieties comprise three tethered ligands covalently attached to a branching group.

In certain embodiments, the cell-targeting moiety comprises a branching group comprising one or more groups selected from alkyl, amino, oxo, amide, disulfide, polyethylene glycol, ether, thioether and hydroxylamino groups. In certain embodiments, the branching group comprises a branched aliphatic group comprising groups selected from alkyl, amino, oxo, amide, disulfide, polyethylene glycol, ether, thioether and hydroxylamino groups. In certain such embodiments, the branched aliphatic group comprises groups selected from alkyl, amino, oxo, amide and ether groups. In certain such embodiments, the branched aliphatic group comprises groups selected from alkyl, amino and ether groups. In certain such embodiments, the branched aliphatic group comprises groups selected from alkyl and ether groups. In certain embodiments, the branching group comprises a mono or polycyclic ring system.

In certain embodiments, each tether of a cell-targeting moiety comprises one or more groups selected from alkyl, substituted alkyl, ether, thioether, disulfide, amino, oxo, amide, phosphodiester, and polyethylene glycol, in any combination. In certain embodiments, each tether is a linear aliphatic group comprising one or more groups selected from alkyl, ether, thioether, disulfide, amino, oxo, amide, and polyethylene glycol, in any combination. In certain embodiments, each tether is a linear aliphatic group comprising one or more groups selected from alkyl, phosphodiester, ether, amino, oxo, and amide, in any combination. In certain embodiments, each tether is a linear aliphatic group comprising one or more groups selected from alkyl, ether, amino, oxo, and amid, in any combination. In certain embodiments, each tether is a linear aliphatic group comprising one or more groups selected from alkyl, amino, and oxo, in any combination. In certain embodiments, each tether is a linear aliphatic group comprising one or more groups selected from alkyl and oxo, in any combination. In certain embodiments, each tether is a linear aliphatic group comprising one or more groups selected from alkyl and phosphodiester, in any combination. In certain embodiments, each tether comprises at least one phosphorus linking group or neutral linking group. In certain embodiments, each tether comprises a chain from about 6 to about 20 atoms in length. In certain embodiments, each tether comprises a chain from about 10 to about 18 atoms in length. In certain embodiments, each tether comprises about 10 atoms in chain length.

In certain embodiments, each ligand of a cell-targeting moiety has an affinity for at least one type of receptor on a target cell. In certain embodiments, each ligand has an affinity for at least one type of receptor on the surface of a mammalian liver cell. In certain embodiments, each ligand has an affinity for the hepatic asialoglycoprotein receptor (ASGP-R). In certain embodiments, each ligand is a carbohydrate. In certain embodiments, each ligand is, independently selected from galactose, N-acetyl galactoseamine (GalNAc), mannose, glucose, glucoseamine and fucose. In certain embodiments, each ligand is N-acetyl galactoseamine (GalNAc). In certain embodiments, the cell-targeting moiety comprises 3 GalNAc ligands. In certain embodiments, the cell-targeting moiety comprises 2 GalNAc ligands. In certain embodiments, the cell-targeting moiety comprises 1 GalNAc ligand.

In certain embodiments, each ligand of a cell-targeting moiety is a carbohydrate, carbohydrate derivative, modified carbohydrate, polysaccharide, modified polysaccharide, or polysaccharide derivative. In certain such embodiments, the conjugate group comprises a carbohydrate cluster (see, e.g., Maier et al., "Synthesis of Antisense Oligonucleotides Conjugated to a Multivalent Carbohydrate Cluster for Cellular Targeting," *Bioconjugate Chemistry*, 2003, 14, 18-29, or Rensen et al., "Design and Synthesis of Novel N-Acetylgalactosamine-Terminated Glycolipids for Targeting of Lipoproteins to the Hepatic Asiaglycoprotein Receptor," *J. Med. Chem.* 2004, 47, 5798-5808, which are incorporated herein by reference in their entirety). In certain such embodiments, each ligand is an amino sugar or a thio sugar. For example, amino sugars may be selected from any number of compounds known in the art, such as sialic acid, α-D-galactosamine, β-muramic acid, 2-deoxy-2-methylamino-L-glucopyranose, 4,6-dideoxy-4-formamido-2,3-di-O-methyl-D-mannopyranose, 2-deoxy-2-sulfoamino-D-glucopyranose and N-sulfo-D-glucosamine, and N-glycoloyl-α-neuraminic acid. For example, thio sugars may be selected from 5-Thio-β-D-glucopyranose, methyl 2,3,4-tri-O-acetyl-1-thio-6-O-trityl-α-D-glucopyranoside, 4-thio-β-D-galactopyranose, and ethyl 3,4,6,7-tetra-O-acetyl-2-deoxy-1,5-dithio-α-D-gluco-heptopyranoside.

In certain embodiments, conjugate groups comprise a cell-targeting moiety having the formula:
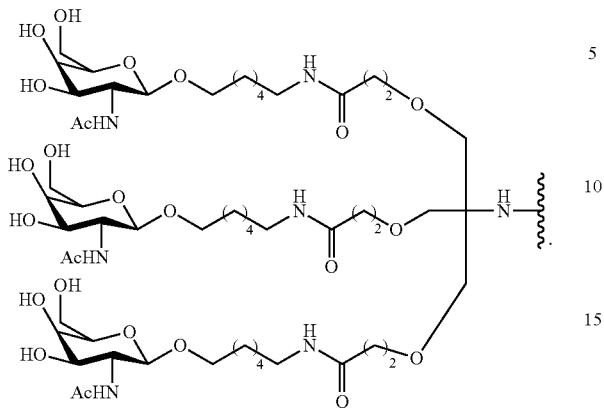
In certain embodiments, conjugate groups comprise a cell-targeting moiety having the formula:
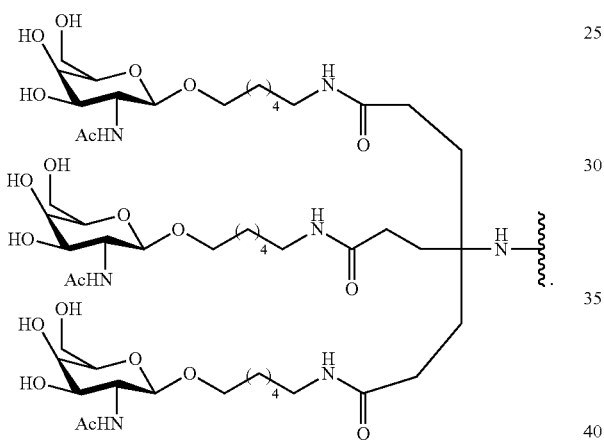
In certain embodiments, conjugate groups comprise a cell-targeting moiety having the formula:
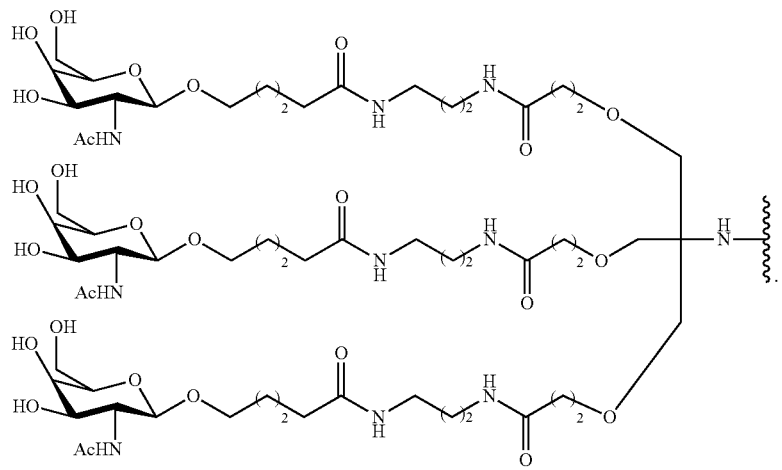

In certain embodiments, antisense compounds and oligomeric compounds comprise a conjugate group and conjugate linker described herein as "LICA-1". LICA-1 has the formula:

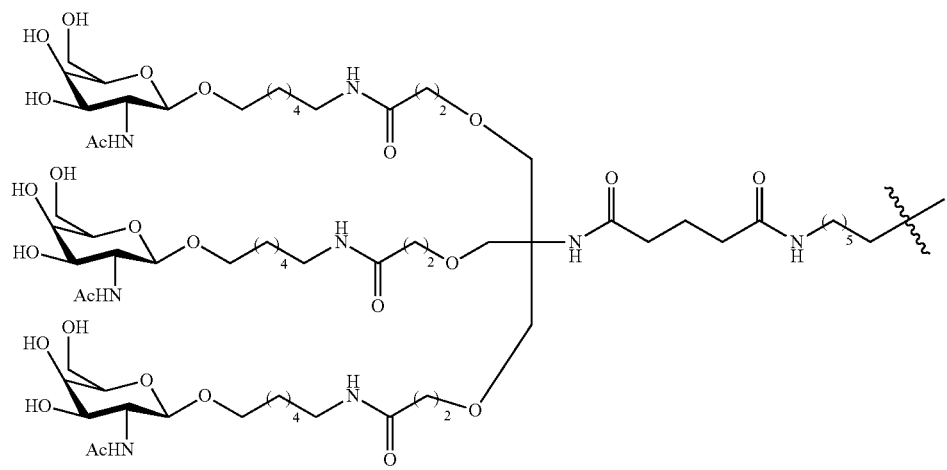

In certain embodiments, antisense compounds and oligomeric compounds comprising LICA-1 have the formula:

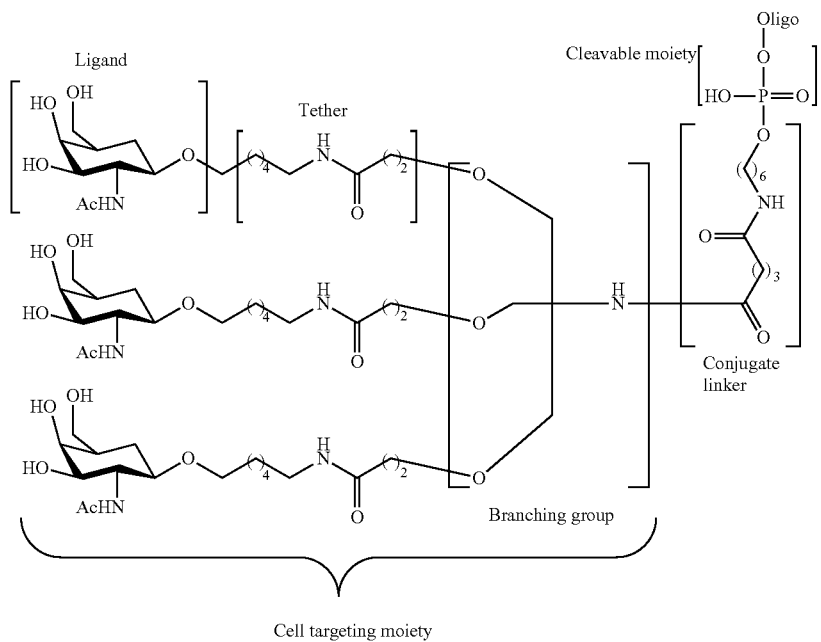

wherein oligo is an oligonucleotide.

Representative United States patents, United States patent application publications, international patent application publications, and other publications that teach the preparation of certain of the above noted conjugate groups, oligomeric compounds and antisense compounds comprising conjugate groups, tethers, conjugate linkers, branching groups, ligands, cleavable moieties as well as other modifications include without limitation, U.S. Pat. Nos. 5,994,517, 6,300,319, 6,660,720, 6,906,182, 7,262,177, 7,491,805, 8,106,022, 7,723,509, US 2006/0148740, US 2011/0123520, WO 2013/033230 and WO 2012/037254, Biessen et al., J Med. Chem. 1995, 38, 1846-1852, Lee et al., Bioorganic & Medicinal Chemistry 2011, 19, 2494-2500, Rensen et al., J Biol. Chem. 2001, 276, 37577-37584, Rensen et al., J Med. Chem. 2004, 47, 5798-5808, Sliedregt et al., J Med. Chem. 1999, 42, 609-618, and Valentijn et al., Tetrahedron, 1997, 53, 759-770, each of which is incorporated by reference herein in its entirety.

In certain embodiments, antisense compounds and oligomeric compounds comprise modified oligonucleotides comprising a gapmer or fully modified motif and a conjugate group comprising at least one, two, or three GalNAc ligands. In certain embodiments antisense compounds and oligomeric compounds comprise a conjugate group found in any of the following references: Lee, *Carbohydr Res*, 1978, 67, 509-514; Connolly et al., *J Biol Chem*, 1982, 257, 939-945; Pavia et al., *Int J Pep Protein Res*, 1983, 22, 539-548; Lee et al., *Biochem*, 1984, 23, 4255-4261; Lee et al., *Glycoconjugate J*, 1987, 4, 317-328; Toyokuni et al., *Tetrahedron Lett*, 1990, 31, 2673-2676; Biessen et al., *J Med Chem*, 1995, 38, 1538-1546; Valentijn et al., *Tetrahedron*, 1997, 53, 759-770; Kim et al., *Tetrahedron Lett*, 1997, 38, 3487-3490; Lee et al., *Bioconjug Chem*, 1997, 8, 762-765; Kato et al., *Glycobiol*, 2001, 11, 821-829; Rensen et al., *J Biol Chem*, 2001, 276, 37577-37584; Lee et al., *Methods Enzymol*, 2003, 362, 38-43; Westerlind et al., *Glycoconj J*, 2004, 21, 227-241; Lee et al., *Bioorg Med Chem Lett*, 2006, 16(19), 5132-5135; Maierhofer et al., *Bioorg Med Chem*, 2007, 15, 7661-7676; Khorev et al., *Bioorg Med Chem*, 2008, 16, 5216-5231; Lee et al., *Bioorg Med Chem*, 2011, 19, 2494-2500; Kornilova et al., *Analyt Biochem*, 2012, 425, 43-46; Pujol et al., *Angew Chemie Int Ed Engl*, 2012, 51, 7445-7448; Biessen et al., *J Med Chem*, 1995, 38, 1846-1852; Sliedregt et al., *J Med Chem*, 1999, 42, 609-618; Rensen et al., *J Med Chem*, 2004, 47, 5798-5808; Rensen et al., *Arterioscler Thromb Vasc Biol*, 2006, 26, 169-175; van Rossenberg et al., *Gene Ther*, 2004, 11, 457-464; Sato et al., *J Am Chem Soc*, 2004, 126, 14013-14022; Lee et al., *J Org Chem*, 2012, 77, 7564-7571; Biessen et al., *FASEB J*, 2000, 14, 1784-1792; Rajur et al., *Bioconjug Chem*, 1997, 8, 935-940; Duff et al., *Methods Enzymol*, 2000, 313, 297-321; Maier et al., *Bioconjug Chem*, 2003, 14, 18-29; Jayaprakash et al., *Org Lett*, 2010, 12, 5410-5413; Manoharan, *Antisense Nucleic Acid Drug Dev*, 2002, 12, 103-128; Merwin et al., *Bioconjug Chem*, 1994, 5, 612-620; Tomiya et al., *Bioorg Med Chem*, 2013, 21, 5275-5281; International applications WO1998/013381; WO2011/038356; WO1997/046098; WO2008/098788; WO2004/101619; WO2012/037254; WO2011/120053; WO2011/100131; WO2011/163121; WO2012/177947; WO2013/033230; WO2013/075035; WO2012/083185; WO2012/083046; WO2009/082607; WO2009/134487; WO2010/144740; WO2010/148013; WO1997/020563; WO2010/088537; WO2002/043771; WO2010/129709; WO2012/068187; WO2009/126933; WO2004/024757; WO2010/054406; WO2012/089352; WO2012/089602; WO2013/166121; WO2013/165816; U.S. Pat. Nos. 4,751,219; 8,552,163; 6,908,903; 7,262,177; 5,994,517; 6,300,319; 8,106,022; 7,491,805; 7,491,805; 7,582,744; 8,137,695; 6,383,812; 6,525,031; 6,660,720; 7,723,509; 8,541,548; 8,344,125; 8,313,772; 8,349,308; 8,450,467; 8,501,930; 8,158,601; 7,262,177; 6,906,182; 6,620,916; 8,435,491; 8,404,862; 7,851,615; Published U.S. Patent Application Publications US2011/0097264; US2011/0097265; US2013/0004427; US2005/0164235; US2006/0148740; US2008/0281044; US2010/0240730; US2003/0119724; US2006/0183886; US2008/0206869; US2011/0269814; US2009/0286973; US2011/0207799; US2012/0136042; US2012/0165393; US2008/0281041; U52009/0203135; US2012/0035115; US2012/0095075; US2012/0101148; US2012/0128760; US2012/0157509; US2012/0230938; US2013/0109817; US2013/0121954; US2013/0178512; US2013/0236968; US2011/0123520; US2003/0077829; US2008/0108801; and US2009/0203132; each of which is incorporated by reference in its entirety.

In certain embodiments, a modified oligonucleotide targeting DGAT2 described herein further comprises a GalNAc conjugate group. In certain embodiments, the GalNAc conjugate group is 5'-Trishexylamino-(THA)-C6 GalNAc$_3$. In certain embodiments, the 5'-Trishexylamino-(THA)-C6 GalNAc$_3$ conjugate has the formula

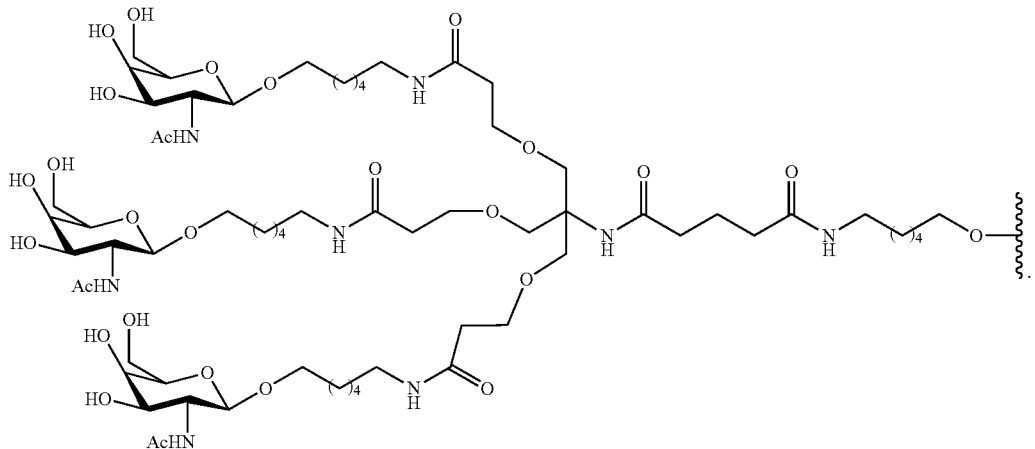

In certain embodiments, the modified oligonucleotide is linked to the 5'-Trishexylamino-(THA)-C6 GalNAc$_3$ conjugate by a cleavable moiety. In certain embodiments, the cleavable moiety is a phosphate group.

Compositions and Methods for Formulating Pharmaceutical Compositions

In certain embodiments, the present invention provides pharmaceutical compositions comprising one or more antisense compound or a salt thereof. In certain such embodiments, the pharmaceutical composition comprises a suitable pharmaceutically acceptable diluent or carrier. In certain embodiments, a pharmaceutical composition comprises a sterile saline solution and one or more antisense compound. In certain embodiments, such pharmaceutical composition consists of a sterile saline solution and one or more antisense compound. In certain embodiments, the sterile saline is pharmaceutical grade saline. In certain embodiments, a pharmaceutical composition comprises one or more antisense compound and sterile water. In certain embodiments, a pharmaceutical composition consists of one antisense compound and sterile water. In certain embodiments, the sterile water is pharmaceutical grade water. In certain embodiments, a pharmaceutical composition comprises one or more antisense compound and phosphate-buffered saline (PBS). In certain embodiments, a pharmaceutical composition consists of one or more antisense compound and sterile PBS. In certain embodiments, the sterile PBS is pharmaceutical grade PBS. Compositions and methods for the formulation of pharmaceutical compositions are dependent upon a number of criteria, including, but not limited to, route of administration, extent of disease, or dose to be administered.

An antisense compound targeted to DGAT2 nucleic acid can be utilized in pharmaceutical compositions by combining the antisense compound with a suitable pharmaceutically acceptable diluent or carrier. In certain embodiments, a pharmaceutically acceptable diluent is water, such as sterile water suitable for injection. Accordingly, in one embodiment, employed in the methods described herein is a pharmaceutical composition comprising an antisense compound targeted to DGAT2 nucleic acid and a pharmaceutically acceptable diluent. In certain embodiments, the pharmaceutically acceptable diluent is water. In certain embodiments, the antisense compound is an antisense oligonucleotide provided herein.

Pharmaceutical compositions comprising antisense compounds encompass any pharmaceutically acceptable salts, esters, or salts of such esters, or any other oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an antisense compound which are cleaved by endogenous nucleases within the body, to form the active antisense compound.

In certain embodiments, the compounds or compositions further comprise a pharmaceutically acceptable carrier or diluent.

Certain Compounds

In vitro screens in human HepG2 cells were performed with about 5,000 antisense oligonucleotides that exhibited 100% complementarity to a human DGAT2 gene sequence. The new compounds were compared with previously designed compounds, which have been previously determined to be some of the most potent antisense compounds in vitro (see, e.g. published PCT application WO 2005/019418). From these in vitro screens, several antisense oligonucleotides that exhibited the greatest potency in reducing the expression of human DGAT2 mRNA were selected for in vivo tolerability assays.

The selected oligonucleotides were tested for tolerability in a CD1 mouse model, as well as a Sprague-Dawley rat model. In these models, body weights and organ weights, liver function markers (such as alanine transaminase, aspartate transaminase, and bilirubin), and kidney function markers (such as BUN and creatinine) were measured.

Final evaluation of all studies (Examples 1-15) led to the selection of eight oligonucleotids having a nuclebase sequence of SEQ ID NO: 1371 (ISIS 484085), SEQ ID NO: 1415 (ISIS 484129), SEQ ID NO: 1423 (ISIS484137), SEQ ID NO: 1844 (ISIS 495576), SEQ ID NO: 2959 (ISIS 501861), SEQ ID NO: 3292 (ISIS 502194), SEQ ID NO: 4198 (ISIS 525443), and SEQ ID NO: 4373 (ISIS 525612). The compounds are complementary to the regions 23242-23261, 26630-26649, 26778-26797, 15251-15270, 28026-28045, 35436-35455, 10820-10836, and 23246-23262. In certain embodiments, the compounds targeting the listed regions, as further described herein, comprise a modified oligonucleotide having some nucleobase portion of the sequence recited in the SEQ ID Nos, as further described herein. In certain embodiments, the compounds targeting the listed regions or having a nucleobase portion of a sequence recited in the listed SEQ ID Nos can be of various lengths, as further described herein, and can have one of various motifs, as further described herein. In certain embodiments, a compound targeting a region or having a nucleobase portion of a sequence in the listed SEQ ID Nos has the specific length and motif, as indicated by the ISIS Nos: 484085, 484129, 484137, 495576, 501861, 502194, 525443, and 525612.

These eight compounds were tested for activity, pharmacokinetic profile and tolerability in cynomolgus monkeys (Example 16). Specifically, ISIS 484137 was found to be potent and the most tolerable in this monkey study. Further evaluation of ISIS 484137 in a separate monkey study (Example 17) confirmed this finding.

The nucleotide sequence of ISIS 484137 is fully homologous to the rhesus monkey DGAT2 mRNA transcript. The cynomolgus monkey is regarded as a relevant preclinical safety model system for oligonucleotide therapeutics and the demonstrated pharmacologic activity of ISIS 484137 in this species makes it an appropriate species for safety assessment. General toxicology studies were conducted with ISIS 484137 in monkeys for 13 weeks of treatment and it was well tolerated with no overt adverse effects and no changes in routine laboratory parameters. ISIS 484137 reduced the expression of hepatic DGAT2 by about 70%.

The findings observed in mice and monkey toxicology studies following 13-weeks of ISIS 484137 treatment were, in general, non-specific class effects that are typical for 2'-MOE ASOs. There was no drug-related mortality or changes in clinical signs up to the highest doses tested (100 mg/kg in mice and 40 mg/kg in monkeys). There were no toxicologically significant findings at doses up to 12 mg/kg/wk for 13 weeks in the mouse and monkey studies, and therefore there is sufficient therapeutic margin to support the safe clinical use of ISIS 484137 at the proposed clinical doses and regimen.

The pharmacokinetic results confirm continuous and dose-dependent exposure to ISIS 484137 in the 13-week mouse and monkey studies. Pharmacokinetics observed in monkeys for antisense oligonucleotides typically well predict the observed plasma (and expected tissue) exposure levels in humans on the basis of mg/kg equivalent doses (Geary et al. 2003; 31: 1419-1428; Yu et al. Drug Metab Dispos 2007; 35: 460-468).

Thus, reduction of DGAT2 expression with ISIS 484137 provides a mechanism to reduce hepatic steatosis, thereby potentially attenuating subsequent inflammation and fibrosis. This mechanism of action could offer an attractive treatment option for patients who have significant hepatic steatosis associated with NAFLD and NASH.

EXAMPLES

The Examples below describe the screening process to identify the lead compounds targeted to DGAT2. Out of about 5,000 antisense oligonucleotides screened, ISIS 484085, ISIS 484129, ISIS 484137, ISIS 495576, ISIS 501861, ISIS 502194, ISIS 525443, and ISIS 525612 emerged as the top lead compounds. In particular, ISIS 484137 exhibited the best combination of properties in terms of potency and tolerability for DGAT2 out of about 5,000 antisense oligonucleotides.

Non-Limiting Disclosure and Incorporation by Reference

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'—OH sugar moiety and a thymine base could be described as a DNA having a modified sugar (2'—OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligonucleotide having the nucleobase sequence "ATCGATCG" encompasses any oligonucleotides having such nucleobase sequence, whether modified or unmodified, including, but not limited to, such compounds comprising RNA bases, such as those having sequence "AUCGAUCG" and those having some DNA bases and some RNA bases such as "AUCGATCG".

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1: Antisense Inhibition of Human Diacylglycerol Acyltransferase 2 in HepG2 Cells by MOE Gapmers Antisense oligonucleotides were designed targeting a diacylglycerol acyltransferase 2 (DGAT2) nucleic acid and were tested for their effects on DGAT2 mRNA in vitro. The antisense oligonucleotides were tested in a series of experiments that had similar culture conditions. The results for each experiment are presented in separate tables shown below. Cultured HepG2 cells at a density of 10,000 cells per well were transfected using Lipofectin reagent with 120 nM antisense oligonucleotide. After a treatment period of approximately 24 hours, RNA was isolated from the cells and DGAT2 mRNA levels were measured by quantitative real-time PCR. Human primer probe set RTS2367 (forward sequence GGCCTCCCGGAGACTGA, designated herein as SEQ ID NO: 4; reverse sequence AAGTGATTGCAGCTGGTTCCT, designated herein as SEQ ID NO: 5; probe sequence AGGTGAACTGAGCCAGCCTTCGGG, designated herein as SEQ ID NO: 6) was used to measure mRNA levels. DGAT2 mRNA levels were adjusted according to total RNA content, as measured by RIBOGREEN®. Results are presented as percent inhibition of DGAT2, relative to untreated control cells.

ISIS oligonucleotides from an earlier published application, WO 2005/019418, were also included in this assay. These ISIS oligonucleotides are ISIS 217312-217322, ISIS 217324, ISIS 217325, ISIS 217328, ISIS 217333, ISIS 217336-217339, ISIS 217341-217343, ISIS 217346-217348, ISIS 217353-217355, ISIS 334177, ISIS 366710, ISIS 366714, ISIS 366722, ISIS 366728, ISIS 366730, ISIS 366741, ISIS 366746, ISIS 369220, ISIS 369221, ISIS 369255, ISIS 370727, ISIS 370747, ISIS 370784.

The newly designed chimeric antisense oligonucleotides in the Tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the Tables below is targeted to either the human DGAT2 mRNA, designated herein as SEQ ID NO: 1 (RefSeq No. NM_032564.3) or the human DGAT2 genomic sequence, designated herein as SEQ ID NO: 2 (RefSeq No. NT_033927.5 truncated from nucleotides 5669186 to 5712008). 'n/a' indicates that the antisense oligonucleotide does not target that particular gene sequence with 100% complementarity.

TABLE 1

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 381726 | 278 | 297 | CGCAGGACCCCGGAGTAGGC | 75 | 9899 | 9918 | 38 |
| 217312 | 668 | 687 | TGGATGGGAAAGTAGTCTCG | 40 | 31600 | 31619 | 16 |
| 411887 | 669 | 688 | CTGGATGGGAAAGTAGTCTC | 38 | 31601 | 31620 | 50 |
| 411888 | 670 | 689 | GCTGGATGGGAAAGTAGTCT | 22 | n/a | n/a | 51 |
| 411889 | 671 | 690 | AGCTGGATGGGAAAGTAGTC | 31 | n/a | n/a | 52 |
| 411890 | 672 | 691 | CAGCTGGATGGGAAAGTAGT | 21 | n/a | n/a | 53 |

TABLE 1-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 217313 | 673 | 692 | CCAGCTGGATGGGAAAGTAG | 24 | n/a | n/a | 17 |
| 411891 | 674 | 693 | ACCAGCTGGATGGGAAAGTA | 21 | n/a | n/a | 54 |
| 380109 | 675 | 694 | CACCAGCTGGATGGGAAAGT | 31 | n/a | n/a | 35 |
| 411892 | 676 | 695 | TCACCAGCTGGATGGGAAAG | 22 | n/a | n/a | 55 |
| 411893 | 677 | 696 | TTCACCAGCTGGATGGGAAA | 26 | n/a | n/a | 56 |
| 217314 | 678 | 697 | CTTCACCAGCTGGATGGGAA | 36 | n/a | n/a | 18 |
| 369219 | 679 | 698 | TCTTCACCAGCTGGATGGGA | 50 | n/a | n/a | 32 |
| 411894 | 680 | 699 | GTCTTCACCAGCTGGATGGG | 42 | n/a | n/a | 57 |
| 411895 | 681 | 700 | TGTCTTCACCAGCTGGATGG | 55 | n/a | n/a | 58 |
| 411896 | 682 | 701 | GTGTCTTCACCAGCTGGATG | 49 | n/a | n/a | 59 |
| 217315 | 683 | 702 | TGTGTCTTCACCAGCTGGAT | 55 | n/a | n/a | 19 |
| 380110 | 684 | 703 | GTGTGTCTTCACCAGCTGGA | 53 | n/a | n/a | 36 |
| 411897 | 685 | 704 | TGTGTGTCTTCACCAGCTGG | 55 | n/a | n/a | 60 |
| 411873 | 686 | 705 | TTGTGTGTCTTCACCAGCTG | 63 | 37214 | 37233 | 46 |
| 411898 | 687 | 706 | GTTGTGTGTCTTCACCAGCT | 54 | 37215 | 37234 | 61 |
| 217316 | 688 | 707 | GGTTGTGTGTCTTCACCAGC | 64 | 37216 | 37235 | 20 |
| 381727 | 689 | 708 | AGGTTGTGTGTCTTCACCAG | 59 | 37217 | 37236 | 39 |
| 411899 | 690 | 709 | CAGGTTGTGTGTCTTCACCA | 68 | 37218 | 37237 | 62 |
| 411874 | 691 | 710 | GCAGGTTGTGTGTCTTCACC | 65 | 37219 | 37238 | 47 |
| 411900 | 692 | 711 | AGCAGGTTGTGTGTCTTCAC | 55 | 37220 | 37239 | 63 |
| 217317 | 693 | 712 | CAGCAGGTTGTGTGTCTTCA | 66 | 37221 | 37240 | 21 |
| 381728 | 694 | 713 | TCAGCAGGTTGTGTGTCTTC | 56 | 37222 | 37241 | 40 |
| 411901 | 695 | 714 | GTCAGCAGGTTGTGTGTCTT | 64 | 37223 | 37242 | 64 |
| 411875 | 696 | 715 | GGTCAGCAGGTTGTGTGTCT | 45 | 37224 | 37243 | 48 |
| 411902 | 697 | 716 | TGGTCAGCAGGTTGTGTGTC | 55 | 37225 | 37244 | 65 |
| 217318 | 698 | 717 | GTGGTCAGCAGGTTGTGTGT | 44 | 37226 | 37245 | 22 |
| 369220 | 699 | 718 | GGTGGTCAGCAGGTTGTGTG | 29 | 37227 | 37246 | 33 |
| 411903 | 700 | 719 | TGGTGGTCAGCAGGTTGTGT | 51 | 37228 | 37247 | 66 |
| 411904 | 701 | 720 | CTGGTGGTCAGCAGGTTGTG | 57 | 37229 | 37248 | 67 |
| 411905 | 702 | 721 | CCTGGTGGTCAGCAGGTTGT | 64 | 37230 | 37249 | 68 |
| 217319 | 703 | 722 | TCCTGGTGGTCAGCAGGTTG | 58 | 37231 | 37250 | 23 |
| 381729 | 704 | 723 | TTCCTGGTGGTCAGCAGGTT | 61 | 37232 | 37251 | 41 |
| 411906 | 705 | 724 | GTTCCTGGTGGTCAGCAGGT | 63 | 37233 | 37252 | 69 |
| 411907 | 706 | 725 | AGTTCCTGGTGGTCAGCAGG | 58 | 37234 | 37253 | 70 |
| 411908 | 707 | 726 | TAGTTCCTGGTGGTCAGCAG | 48 | 37235 | 37254 | 71 |

TABLE 1-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 217320 | 708 | 727 | ATAGTTCCTGGTGGTCAGCA | 46 | 37236 | 37255 | 24 |
| 381730 | 709 | 728 | TATAGTTCCTGGTGGTCAGC | 56 | 37237 | 37256 | 42 |
| 411909 | 710 | 729 | ATATAGTTCCTGGTGGTCAG | 53 | 37238 | 37257 | 72 |
| 411876 | 711 | 730 | GATATAGTTCCTGGTGGTCA | 57 | 37239 | 37258 | 49 |
| 411910 | 712 | 731 | AGATATAGTTCCTGGTGGTC | 56 | 37240 | 37259 | 73 |
| 217321 | 713 | 732 | AAGATATAGTTCCTGGTGGT | 41 | 37241 | 37260 | 25 |
| 381731 | 714 | 733 | AAAGATATAGTTCCTGGTGG | 54 | 37242 | 37261 | 43 |
| 411911 | 715 | 734 | CAAAGATATAGTTCCTGGTG | 61 | 37243 | 37262 | 74 |
| 411912 | 716 | 735 | CCAAAGATATAGTTCCTGGT | 66 | 37244 | 37263 | 75 |
| 411913 | 717 | 736 | TCCAAAGATATAGTTCCTGG | 63 | 37245 | 37264 | 76 |
| 217322 | 718 | 737 | ATCCAAAGATATAGTTCCTG | 39 | 37246 | 37265 | 26 |
| 369221 | 719 | 738 | TATCCAAAGATATAGTTCCT | 13 | 37247 | 37266 | 34 |
| 411914 | 720 | 739 | GTATCCAAAGATATAGTTCC | 8 | 37248 | 37267 | 77 |
| 411915 | 721 | 740 | GGTATCCAAAGATATAGTTC | 43 | 37249 | 37268 | 78 |
| 411916 | 722 | 741 | TGGTATCCAAAGATATAGTT | 42 | 37250 | 37269 | 79 |
| 217324 | 752 | 771 | AAGGCACCCAGGCCCATGAT | 46 | 37280 | 37299 | 27 |
| 381732 | 753 | 772 | GAAGGCACCCAGGCCCATGA | 38 | 37281 | 37300 | 44 |
| 380114 | 754 | 773 | AGAAGGCACCCAGGCCCATG | 38 | 37282 | 37301 | 37 |
| 411917 | 755 | 774 | CAGAAGGCACCCAGGCCCAT | 33 | 37283 | 37302 | 80 |
| 217325 | 875 | 894 | CCTCCAGACATCAGGTACTC | 29 | 37403 | 37422 | 28 |
| 217333 | 992 | 1011 | TTGCCAGGCATGGAGCTCAG | 37 | 38145 | 38164 | 29 |
| 381733 | 993 | 1012 | CTTGCCAGGCATGGAGCTCA | 51 | 38146 | 38165 | 45 |
| 411918 | 994 | 1013 | TCTTGCCAGGCATGGAGCTC | 47 | 38147 | 38166 | 81 |
| 411919 | 995 | 1014 | TTCTTGCCAGGCATGGAGCT | 54 | 38148 | 38167 | 82 |
| 217336 | 1139 | 1158 | TGGACCCATCGGCCCCAGGA | 52 | 39186 | 39205 | 30 |
| 411920 | 1140 | 1159 | CTGGACCCATCGGCCCCAGG | 41 | 39187 | 39206 | 83 |
| 411921 | 1141 | 1160 | TCTGGACCCATCGGCCCCAG | 20 | 39188 | 39207 | 84 |
| 411922 | 1142 | 1161 | TTCTGGACCCATCGGCCCCA | 27 | 39189 | 39208 | 85 |
| 411923 | 1143 | 1162 | CTTCTGGACCCATCGGCCCC | 30 | 39190 | 39209 | 86 |
| 217337 | 1144 | 1163 | TCTTCTGGACCCATCGGCCC | 37 | 39191 | 39210 | 31 |
| 411924 | 1145 | 1164 | TTCTTCTGGACCCATCGGCC | 44 | 39192 | 39211 | 87 |
| 411925 | 1146 | 1165 | CTTCTTCTGGACCCATCGGC | 27 | 39193 | 39212 | 88 |
| 411926 | 1147 | 1166 | ACTTCTTCTGGACCCATCGG | 28 | 39194 | 39213 | 89 |
| 411927 | 1148 | 1167 | AACTTCTTCTGGACCCATCG | 28 | 39195 | 39214 | 90 |

TABLE 2

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 217338 | 1149 | 1168 | GAACTTCTTCTGGACCCATC | 19 | 39196 | 39215 | 91 |
| 411928 | 1150 | 1169 | GGAACTTCTTCTGGACCCAT | 36 | 39197 | 39216 | 104 |
| 411929 | 1151 | 1170 | TGGAACTTCTTCTGGACCCA | 43 | 39198 | 39217 | 105 |
| 411930 | 1152 | 1171 | CTGGAACTTCTTCTGGACCC | 25 | 39199 | 39218 | 106 |
| 411931 | 1153 | 1172 | TCTGGAACTTCTTCTGGACC | 43 | 39200 | 39219 | 107 |
| 217339 | 1154 | 1173 | TTCTGGAACTTCTTCTGGAC | 37 | 39201 | 39220 | 92 |
| 217341 | 1226 | 1245 | GGCACCAGCCCCAGGTGTC | 30 | 39273 | 39292 | 93 |
| 411932 | 1227 | 1246 | GGGCACCAGCCCCAGGTGT | 34 | 39274 | 39293 | 108 |
| 411933 | 1228 | 1247 | AGGGCACCAGCCCCAGGTG | 29 | 39275 | 39294 | 109 |
| 411934 | 1229 | 1248 | TAGGGCACCAGCCCCAGGT | 32 | 39276 | 39295 | 110 |
| 411935 | 1230 | 1249 | GTAGGGCACCAGCCCCAGG | 23 | 39277 | 39296 | 111 |
| 217342 | 1231 | 1250 | AGTAGGGCACCAGCCCCAG | 0 | 39278 | 39297 | 94 |
| 411936 | 1232 | 1251 | GAGTAGGGCACCAGCCCCA | 0 | 39279 | 39298 | 112 |
| 411937 | 1233 | 1252 | GGAGTAGGGCACCAGCCCC | 17 | 39280 | 39299 | 113 |
| 411938 | 1234 | 1253 | TGGAGTAGGGCACCAGCCCC | 28 | 39281 | 39300 | 114 |
| 411939 | 1235 | 1254 | TTGGAGTAGGGCACCAGCCC | 16 | 39282 | 39301 | 115 |
| 217343 | 1236 | 1255 | CTTGGAGTAGGGCACCAGCC | 35 | 39283 | 39302 | 95 |
| 411940 | 1237 | 1256 | GCTTGGAGTAGGGCACCAGC | 45 | 39284 | 39303 | 116 |
| 411941 | 1238 | 1257 | GGCTTGGAGTAGGGCACCAG | 56 | 39285 | 39304 | 117 |
| 366741 | 1245 | 1264 | GGTGATGGGCTTGGAGTAGG | 36 | 39292 | 39311 | 102 |
| 411942 | 1246 | 1265 | TGGTGATGGGCTTGGAGTAG | 28 | 39293 | 39312 | 118 |
| 411943 | 1247 | 1266 | GTGGTGATGGGCTTGGAGTA | 23 | 39294 | 39313 | 119 |
| 217346 | 1338 | 1357 | CAGGGCCTCCATGTACATGG | 37 | 41309 | 41328 | 96 |
| 369255 | 1339 | 1358 | CCAGGGCCTCCATGTACATG | 38 | 41310 | 41329 | 103 |
| 411944 | 1340 | 1359 | ACCAGGGCCTCCATGTACAT | 52 | 41311 | 41330 | 120 |
| 411945 | 1341 | 1360 | CACCAGGGCCTCCATGTACA | 53 | 41312 | 41331 | 121 |
| 411946 | 1342 | 1361 | TCACCAGGGCCTCCATGTAC | 37 | 41313 | 41332 | 122 |
| 217347 | 1343 | 1362 | TTCACCAGGGCCTCCATGTA | 20 | 41314 | 41333 | 97 |
| 411947 | 1344 | 1363 | CTTCACCAGGGCCTCCATGT | 46 | 41315 | 41334 | 123 |
| 411948 | 1345 | 1364 | GCTTCACCAGGGCCTCCATG | 31 | 41316 | 41335 | 124 |
| 411949 | 1346 | 1365 | AGCTTCACCAGGGCCTCCAT | 42 | 41317 | 41336 | 125 |
| 411950 | 1347 | 1366 | GAGCTTCACCAGGGCCTCCA | 52 | 41318 | 41337 | 126 |
| 217348 | 1348 | 1367 | AGAGCTTCACCAGGGCCTCC | 46 | 41319 | 41338 | 98 |
| 411951 | 1349 | 1368 | AAGAGCTTCACCAGGGCCTC | 44 | 41320 | 41339 | 127 |
| 217353 | 1498 | 1517 | AACCCACAGACACCCATGAC | 4 | 41469 | 41488 | 99 |
| 411952 | 1499 | 1518 | TAACCCACAGACACCCATGA | 14 | 41470 | 41489 | 128 |

TABLE 2-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 411953 | 1500 | 1519 | ATAACCCACAGACACCCATG | 24 | 41471 | 41490 | 129 |
| 411954 | 1501 | 1520 | AATAACCCACAGACACCCAT | 0 | 41472 | 41491 | 130 |
| 411955 | 1502 | 1521 | AAATAACCCACAGACACCCA | 10 | 41473 | 41492 | 131 |
| 217354 | 1503 | 1522 | TAAATAACCCACAGACACCC | 6 | 41474 | 41493 | 100 |
| 411956 | 1504 | 1523 | TTAAATAACCCACAGACACC | 0 | 41475 | 41494 | 132 |
| 411957 | 1505 | 1524 | TTTAAATAACCCACAGACAC | 14 | 41476 | 41495 | 133 |
| 411958 | 1506 | 1525 | TTTTAAATAACCCACAGACA | 10 | 41477 | 41496 | 134 |
| 411959 | 1507 | 1526 | CTTTTAAATAACCCACAGAC | 0 | 41478 | 41497 | 135 |
| 217355 | 1508 | 1527 | TCTTTTAAATAACCCACAGA | 10 | 41479 | 41498 | 101 |
| 411960 | 1509 | 1528 | TTCTTTTAAATAACCCACAG | 8 | 41480 | 41499 | 136 |
| 411961 | 1510 | 1529 | TTTCTTTTAAATAACCCACA | 1 | 41481 | 41500 | 137 |
| 411962 | 1511 | 1530 | ATTTCTTTTAAATAACCCAC | 1 | 41482 | 41501 | 138 |
| 411963 | 1512 | 1531 | AATTTCTTTTAAATAACCCA | 0 | 41483 | 41502 | 139 |
| 411964 | 1513 | 1532 | TAATTTCTTTTAAATAACCC | 0 | 41484 | 41503 | 140 |
| 411965 | 1514 | 1533 | ATAATTTCTTTTAAATAACC | 0 | 41485 | 41504 | 141 |
| 411966 | 1515 | 1534 | TATAATTTCTTTTAAATAAC | 0 | 41486 | 41505 | 142 |
| 411967 | 1516 | 1535 | TTATAATTTCTTTTAAATAA | 0 | 41487 | 41506 | 143 |

TABLE 3

Inhibition of DGAT2 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 413166 | 254 | 273 | ATGAGGGTCTTCATGGCTGA | 5-10-5 | 7 | 9875 | 9894 | 156 |
| 413167 | 266 | 285 | GAGTAGGCGGCTATGAGGGT | 5-10-5 | 11 | 9887 | 9906 | 157 |
| 413168 | 269 | 288 | CCGGAGTAGGCGGCTATGAG | 5-10-5 | 37 | 9890 | 9909 | 158 |
| 413169 | 272 | 291 | ACCCCGGAGTAGGCGGCTAT | 5-10-5 | 46 | 9893 | 9912 | 159 |
| 334177 | 275 | 294 | AGGACCCCGGAGTAGGCGGC | 5-10-5 | 52 | 9896 | 9915 | 145 |
| 413170 | 304 | 323 | GGTCAGCCTCGGCCTGACGC | 5-10-5 | 11 | 9925 | 9944 | 160 |
| 413171 | 307 | 326 | TCCGGTCAGCCTCGGCCTGA | 5-10-5 | 20 | 9928 | 9947 | 161 |
| 413172 | 310 | 329 | GGCTCCGGTCAGCCTCGGCC | 5-10-5 | 0 | 9931 | 9950 | 162 |
| 413173 | 331 | 350 | CAGGTCCTCCGTGAGAGCGC | 5-10-5 | 29 | 9952 | 9971 | 163 |
| 413174 | 339 | 358 | CGACAGCGCAGGTCCTCCGT | 5-10-5 | 48 | 9960 | 9979 | 164 |
| 413175 | 348 | 367 | CCCCTCGCGCGACAGCGCAG | 5-10-5 | 25 | 9969 | 9988 | 165 |

TABLE 3-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 413176 | 355 | 374 | TCCCAGACCCCTCGCGCGAC | 5-10-5 | 36 | 9976 | 9995 | 166 |
| 413177 | 361 | 380 | CCCATCTCCCAGACCCCTCG | 5-10-5 | 12 | 9982 | 10001 | 167 |
| 413178 | 367 | 386 | CAGTGCCCCATCTCCCAGAC | 5-10-5 | 0 | n/a | n/a | 168 |
| 413179 | 370 | 389 | ATCCAGTGCCCCATCTCCCA | 5-10-5 | 16 | n/a | n/a | 169 |
| 413180 | 376 | 395 | TGCTGGATCCAGTGCCCCAT | 5-10-5 | 44 | n/a | n/a | 170 |
| 413181 | 379 | 398 | GGATGCTGGATCCAGTGCCC | 5-10-5 | 32 | n/a | n/a | 171 |
| 413182 | 382 | 401 | AGAGGATGCTGGATCCAGTG | 5-10-5 | 45 | 25508 | 25527 | 172 |
| 413183 | 385 | 404 | CGGAGAGGATGCTGGATCCA | 5-10-5 | 47 | 25511 | 25530 | 173 |
| 413184 | 396 | 415 | GTCCTGGAGGGCGGAGAGGA | 5-10-5 | 32 | 25522 | 25541 | 174 |
| 413185 | 404 | 423 | GAGAAGAGGTCCTGGAGGGC | 5-10-5 | 10 | 25530 | 25549 | 175 |
| 366710 | 425 | 444 | GACCTATTGAGCCAGGTGAC | 5-10-5 | 36 | 25551 | 25570 | 146 |
| 370727 | 443 | 462 | AGCTGCTTTTCCACCTTGGA | 2-16-2 | 45 | 25569 | 25588 | 152 |
| 366714 | 445 | 464 | GTAGCTGCTTTTCCACCTTG | 5-10-5 | 43 | 25571 | 25590 | 147 |
| 413186 | 448 | 467 | CCTGTAGCTGCTTTTCCACC | 5-10-5 | 29 | 25574 | 25593 | 176 |
| 413187 | 451 | 470 | TGACCTGTAGCTGCTTTTCC | 5-10-5 | 35 | 25577 | 25596 | 177 |
| 413188 | 455 | 474 | GAGATGACCTGTAGCTGCTT | 5-10-5 | 34 | 25581 | 25600 | 178 |
| 413189 | 458 | 477 | ACTGAGATGACCTGTAGCTG | 5-10-5 | 33 | 25584 | 25603 | 179 |
| 413190 | 461 | 480 | AGCACTGAGATGACCTGTAG | 5-10-5 | 36 | 25587 | 25606 | 180 |
| 413191 | 467 | 486 | CACTGGAGCACTGAGATGAC | 5-10-5 | 27 | 25593 | 25612 | 181 |
| 413192 | 473 | 492 | AGGACCCACTGGAGCACTGA | 5-10-5 | 40 | 25599 | 25618 | 182 |
| 413193 | 476 | 495 | GACAGGACCCACTGGAGCAC | 5-10-5 | 44 | 25602 | 25621 | 183 |
| 380089 | 482 | 501 | AGGAAGGACAGGACCCACTG | 5-10-5 | 38 | 25608 | 25627 | 155 |
| 413194 | 494 | 513 | ACTCCCAGTACAAGGAAGGA | 5-10-5 | 3 | n/a | n/a | 184 |
| 413195 | 497 | 516 | GCCACTCCCAGTACAAGGAA | 5-10-5 | 0 | n/a | n/a | 185 |
| 413196 | 500 | 519 | CAGGCCACTCCCAGTACAAG | 5-10-5 | 1 | n/a | n/a | 186 |
| 413197 | 503 | 522 | CTGCAGGCCACTCCCAGTAC | 5-10-5 | 40 | n/a | n/a | 187 |
| 413198 | 506 | 525 | GCACTGCAGGCCACTCCCAG | 5-10-5 | 37 | n/a | n/a | 188 |
| 413199 | 510 | 529 | GATGGCACTGCAGGCCACTC | 5-10-5 | 28 | 31077 | 31096 | 189 |
| 366722 | 530 | 549 | GTGCAGAATATGTACATGAG | 5-10-5 | 43 | 31097 | 31116 | 148 |
| 413200 | 554 | 573 | AGCACAGCGATGAGCCAGCA | 5-10-5 | 35 | 31121 | 31140 | 190 |
| 413201 | 570 | 589 | CAGCCAAGTGAAGTAGAGCA | 5-10-5 | 41 | 31137 | 31156 | 191 |
| 413202 | 573 | 592 | CACCAGCCAAGTGAAGTAGA | 5-10-5 | 23 | 31140 | 31159 | 192 |
| 413203 | 576 | 595 | AAACACCAGCCAAGTGAAGT | 5-10-5 | 9 | 31143 | 31162 | 193 |
| 413204 | 579 | 598 | GTCAAACACCAGCCAAGTGA | 5-10-5 | 15 | 31146 | 31165 | 194 |
| 413205 | 585 | 604 | GTTCCAGTCAAACACCAGCC | 5-10-5 | 31 | 31152 | 31171 | 195 |
| 413206 | 588 | 607 | TGTGTTCCAGTCAAACACCA | 5-10-5 | 23 | 31155 | 31174 | 196 |

TABLE 3-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Sequence | Motif | % inhibition | SEQ ID NO: 2 Start Site | SEQ ID NO: 2 Stop Site | SEQ ID NO |
|---|---|---|---|---|---|---|---|---|
| 413207 | 591 | 610 | GGGTGTGTTCCAGTCAAACA | 5-10-5 | 6 | 31158 | 31177 | 197 |
| 413208 | 594 | 613 | CTTGGGTGTGTTCCAGTCAA | 5-10-5 | 5 | 31161 | 31180 | 198 |
| 413209 | 615 | 634 | CTGTGACCTCCTGCCACCTT | 5-10-5 | 25 | 31547 | 31566 | 199 |
| 413210 | 618 | 637 | CCACTGTGACCTCCTGCCAC | 5-10-5 | 30 | 31550 | 31569 | 200 |
| 413211 | 621 | 640 | GACCCACTGTGACCTCCTGC | 5-10-5 | 25 | 31553 | 31572 | 201 |
| 413212 | 625 | 644 | TTCGGACCCACTGTGACCTC | 5-10-5 | 38 | 31557 | 31576 | 202 |
| 413213 | 629 | 648 | CAGTTTCGGACCCACTGTGA | 5-10-5 | 39 | 31561 | 31580 | 203 |
| 413214 | 632 | 651 | GCCCAGTTTCGGACCCACTG | 5-10-5 | 51 | 31564 | 31583 | 204 |
| 413215 | 635 | 654 | ACAGCCCAGTTTCGGACCCA | 5-10-5 | 27 | 31567 | 31586 | 205 |
| 413216 | 638 | 657 | CACACAGCCCAGTTTCGGAC | 5-10-5 | 24 | 31570 | 31589 | 206 |
| 413217 | 642 | 661 | GCGCCACACAGCCCAGTTTC | 5-10-5 | 31 | 31574 | 31593 | 207 |
| 413218 | 658 | 677 | AGTAGTCTCGAAAGTAGCGC | 5-10-5 | 39 | 31590 | 31609 | 208 |
| 413219 | 661 | 680 | GAAAGTAGTCTCGAAAGTAG | 5-10-5 | 0 | 31593 | 31612 | 209 |
| 413220 | 665 | 684 | ATGGGAAAGTAGTCTCGAAA | 5-10-5 | 0 | 31597 | 31616 | 210 |
| 366728 | 757 | 776 | TGCAGAAGGCACCCAGGCCC | 5-10-5 | 46 | 37285 | 37304 | 149 |
| 413221 | 780 | 799 | TTCTGTGGCCTCTGTGCTGA | 5-10-5 | 25 | 37308 | 37327 | 211 |
| 413222 | 783 | 802 | CACTTCTGTGGCCTCTGTGC | 5-10-5 | 38 | 37311 | 37330 | 212 |
| 413223 | 786 | 805 | GCTCACTTCTGTGGCCTCTG | 5-10-5 | 41 | 37314 | 37333 | 213 |
| 413224 | 789 | 808 | CTTGCTCACTTCTGTGGCCT | 5-10-5 | 48 | 37317 | 37336 | 214 |
| 413225 | 792 | 811 | CTTCTTGCTCACTTCTGTGG | 5-10-5 | 25 | 37320 | 37339 | 215 |
| 413226 | 798 | 817 | TGGGAACTTCTTGCTCACTT | 5-10-5 | 43 | 37326 | 37345 | 216 |
| 413227 | 801 | 820 | GCCTGGGAACTTCTTGCTCA | 5-10-5 | 47 | 37329 | 37348 | 217 |
| 413228 | 804 | 823 | TATGCCTGGGAACTTCTTGC | 5-10-5 | 26 | 37332 | 37351 | 218 |
| 413229 | 808 | 827 | GCCGTATGCCTGGGAACTTC | 5-10-5 | 29 | 37336 | 37355 | 219 |
| 413230 | 811 | 830 | AAGGCCGTATGCCTGGGAAC | 5-10-5 | 25 | 37339 | 37358 | 220 |
| 413231 | 814 | 833 | GGTAAGGCCGTATGCCTGGG | 5-10-5 | 41 | 37342 | 37361 | 221 |
| 217328 | 938 | 957 | GCATTGCCACTCCCATTCTT | 5-10-5 | 41 | 38091 | 38110 | 144 |
| 366730 | 979 | 998 | AGCTCAGAGACTCAGCCGCA | 5-10-5 | 39 | 38132 | 38151 | 150 |
| 370747 | 982 | 1001 | TGGAGCTCAGAGACTCAGCC | 2-16-2 | 37 | 38135 | 38154 | 153 |
| 366746 | 1366 | 1385 | TGGTCTTGTGCTTGTCGAAG | 5-10-5 | 41 | 41337 | 41356 | 151 |
| 370784 | 2128 | 2147 | GCTGCATCCATGTCATCAGC | 2-16-2 | 53 | 42099 | 42118 | 154 |

TABLE 4

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413232 | 817 | 836 | CCAGGTAAGGCCGTATGCCT | 78 | 37345 | 37364 | 225 |
| 413233 | 820 | 839 | TAGCCAGGTAAGGCCGTATG | 56 | 37348 | 37367 | 226 |
| 413234 | 823 | 842 | GTGTAGCCAGGTAAGGCCGT | 50 | 37351 | 37370 | 227 |
| 413235 | 827 | 846 | GCCAGTGTAGCCAGGTAAGG | 9 | 37355 | 37374 | 228 |
| 413236 | 861 | 880 | GTACTCCCTCAACACAGGCA | 72 | 37389 | 37408 | 229 |
| 413237 | 864 | 883 | CAGGTACTCCCTCAACACAG | 52 | 37392 | 37411 | 230 |
| 413238 | 867 | 886 | CATCAGGTACTCCCTCAACA | 35 | 37395 | 37414 | 231 |
| 413239 | 870 | 889 | AGACATCAGGTACTCCCTCA | 35 | 37398 | 37417 | 232 |
| 413240 | 878 | 897 | ATACCTCCAGACATCAGGTA | 50 | n/a | n/a | 233 |
| 413241 | 881 | 900 | CAGATACCTCCAGACATCAG | 38 | n/a | n/a | 234 |
| 413242 | 887 | 906 | ACAGGGCAGATACCTCCAGA | 58 | n/a | n/a | 235 |
| 413243 | 910 | 929 | AATAGTCTATGGTGTCCCGG | 63 | 38063 | 38082 | 236 |
| 413244 | 913 | 932 | GCAAATAGTCTATGGTGTCC | 60 | 38066 | 38085 | 237 |
| 413245 | 916 | 935 | AAAGCAAATAGTCTATGGTG | 46 | 38069 | 38088 | 238 |
| 413246 | 919 | 938 | TTGAAAGCAAATAGTCTATG | 42 | 38072 | 38091 | 239 |
| 413247 | 922 | 941 | TCTTTGAAAGCAAATAGTCT | 40 | 38075 | 38094 | 240 |
| 413248 | 925 | 944 | CATTCTTTGAAAGCAAATAG | 15 | 38078 | 38097 | 241 |
| 413249 | 928 | 947 | TCCCATTCTTTGAAAGCAAA | 31 | 38081 | 38100 | 242 |
| 413250 | 932 | 951 | CCACTCCCATTCTTTGAAAG | 34 | 38085 | 38104 | 243 |
| 413251 | 935 | 954 | TTGCCACTCCCATTCTTTGA | 39 | 38088 | 38107 | 244 |
| 217328 | 938 | 957 | GCATTGCCACTCCCATTCTT | 70 | 38091 | 38110 | 144 |
| 413252 | 976 | 995 | TCAGAGACTCAGCCGCACCC | 43 | 38129 | 38148 | 245 |
| 413253 | 987 | 1006 | AGGCATGGAGCTCAGAGACT | 69 | 38140 | 38159 | 246 |
| 413254 | 1002 | 1021 | GACTGCATTCTTGCCAGGCA | 60 | 38155 | 38174 | 247 |
| 413255 | 1005 | 1024 | GGTGACTGCATTCTTGCCAG | 25 | 38158 | 38177 | 248 |
| 413256 | 1012 | 1031 | TCCGCAGGGTGACTGCATTC | 48 | 38165 | 38184 | 249 |
| 369241 | 1019 | 1038 | TTGCGGTTCCGCAGGGTGAC | 70 | 38172 | 38191 | 222 |
| 413257 | 1022 | 1041 | CCCTTGCGGTTCCGCAGGGT | 36 | 38175 | 38194 | 250 |
| 413258 | 1025 | 1044 | AAGCCCTTGCGGTTCCGCAG | 67 | 38178 | 38197 | 251 |
| 413259 | 1028 | 1047 | ACAAAGCCCTTGCGGTTCCG | 35 | 38181 | 38200 | 252 |
| 413260 | 1034 | 1053 | AGTTTCACAAAGCCCTTGCG | 25 | 38187 | 38206 | 253 |
| 413261 | 1037 | 1056 | GCCAGTTTCACAAAGCCCTT | 34 | 38190 | 38209 | 254 |
| 413262 | 1040 | 1059 | AGGGCCAGTTTCACAAAGCC | 33 | 38193 | 38212 | 255 |
| 413263 | 1043 | 1062 | CGCAGGGCCAGTTTCACAAA | 31 | 38196 | 38215 | 256 |
| 413264 | 1088 | 1107 | TCATTCTCTCCAAAGGAGTA | 18 | 39135 | 39154 | 257 |
| 413265 | 1091 | 1110 | ACTTCATTCTCTCCAAAGGA | 45 | 39138 | 39157 | 258 |

TABLE 4-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413266 | 1095 | 1114 | GTACACTTCATTCTCTCCAA | 82 | 39142 | 39161 | 259 |
| 413267 | 1101 | 1120 | CTGCTTGTACACTTCATTCT | 58 | 39148 | 39167 | 260 |
| 413268 | 1105 | 1124 | TCACCTGCTTGTACACTTCA | 40 | 39152 | 39171 | 261 |
| 413269 | 1111 | 1130 | CGAAGATCACCTGCTTGTAC | 63 | 39158 | 39177 | 262 |
| 413270 | 1114 | 1133 | CCTCGAAGATCACCTGCTTG | 53 | 39161 | 39180 | 263 |
| 413271 | 1117 | 1136 | CCTCCTCGAAGATCACCTGC | 49 | 39164 | 39183 | 264 |
| 413272 | 1120 | 1139 | AGCCCTCCTCGAAGATCACC | 39 | 39167 | 39186 | 265 |
| 413273 | 1123 | 1142 | AGGAGCCCTCCTCGAAGATC | 31 | 39170 | 39189 | 266 |
| 413274 | 1126 | 1145 | CCCAGGAGCCCTCCTCGAAG | 54 | 39173 | 39192 | 267 |
| 413275 | 1129 | 1148 | GGCCCCAGGAGCCCTCCTCG | 40 | 39176 | 39195 | 268 |
| 411877 | 1136 | 1155 | ACCCATCGGCCCCAGGAGCC | 59 | 39183 | 39202 | 223 |
| 413276 | 1157 | 1176 | TATTTCTGGAACTTCTTCTG | 22 | 39204 | 39223 | 269 |
| 413277 | 1160 | 1179 | ATGTATTTCTGGAACTTCTT | 45 | 39207 | 39226 | 270 |
| 413278 | 1171 | 1190 | GGGCGAAACCAATGTATTTC | 24 | 39218 | 39237 | 271 |
| 413279 | 1208 | 1227 | TCGGAGGAGAAGAGGCCTCG | 60 | 39255 | 39274 | 272 |
| 413280 | 1211 | 1230 | GTGTCGGAGGAGAAGAGGCC | 52 | 39258 | 39277 | 273 |
| 413281 | 1215 | 1234 | CCAGGTGTCGGAGGAGAAGA | 53 | 39262 | 39281 | 274 |
| 413282 | 1222 | 1241 | CCAGCCCCAGGTGTCGGAG | 50 | 39269 | 39288 | 275 |
| 413283 | 1250 | 1269 | ACAGTGGTGATGGGCTTGGA | 52 | 39297 | 39316 | 276 |
| 413284 | 1273 | 1292 | GGATGGTGATGGGCTCTCCC | 67 | 41244 | 41263 | 277 |
| 411879 | 1330 | 1349 | CCATGTACATGGTGTGGTAC | 52 | 41301 | 41320 | 224 |
| 413285 | 1334 | 1353 | GCCTCCATGTACATGGTGTG | 63 | 41305 | 41324 | 278 |
| 413286 | 1363 | 1382 | TCTTGTGCTTGTCGAAGAGC | 62 | 41334 | 41353 | 279 |
| 413287 | 1399 | 1418 | CCTCCAGGACCTCAGTCTCC | 66 | 41370 | 41389 | 280 |
| 413288 | 1403 | 1422 | TTCACCTCCAGGACCTCAGT | 46 | 41374 | 41393 | 281 |
| 413289 | 1407 | 1426 | TCAGTTCACCTCCAGGACCT | 46 | 41378 | 41397 | 282 |
| 413290 | 1412 | 1431 | CTGGCTCAGTTCACCTCCAG | 90 | 41383 | 41402 | 283 |
| 413291 | 1537 | 1556 | TGTAATGGTTTAGCAAAATT | 26 | 41508 | 41527 | 284 |
| 413292 | 1555 | 1574 | TTAAAAAGACCTAACATTG | 0 | 41526 | 41545 | 285 |
| 413293 | 1559 | 1578 | CTTCTTAAAAAGACCTAAC | 26 | 41530 | 41549 | 286 |
| 413294 | 1563 | 1582 | TTTCCTTCTTAAAAAGACC | 9 | 41534 | 41553 | 287 |
| 413295 | 1567 | 1586 | ACTTTTTCCTTCTTAAAAA | 0 | 41538 | 41557 | 288 |
| 413296 | 1572 | 1591 | TACTGACTTTTTCCTTCTTA | 39 | 41543 | 41562 | 289 |
| 413297 | 1616 | 1635 | CCACCACCTAGAACAGGGCA | 55 | 41587 | 41606 | 290 |
| 413298 | 1653 | 1672 | AGGTTAGCTGAGCCACCCAG | 59 | 41624 | 41643 | 291 |

TABLE 4-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413299 | 1840 | 1859 | GTCCTGCAGTTTCAGGACTA | 54 | 41811 | 41830 | 292 |
| 413300 | 1844 | 1863 | ACTGGTCCTGCAGTTTCAGG | 55 | 41815 | 41834 | 293 |
| 413301 | 1860 | 1879 | TCCCCTTGGCAGAGAAACTG | 47 | 41831 | 41850 | 294 |
| 413302 | 1864 | 1883 | CTCCTCCCCTTGGCAGAGAA | 43 | 41835 | 41854 | 295 |
| 413303 | 1868 | 1887 | CCAACTCCTCCCCTTGGCAG | 28 | 41839 | 41858 | 296 |
| 413304 | 1872 | 1891 | CTCTCCAACTCCTCCCCTTG | 25 | 41843 | 41862 | 297 |
| 413305 | 1875 | 1894 | GTGCTCTCCAACTCCTCCCC | 34 | 41846 | 41865 | 298 |

TABLE 5

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413347 | n/a | n/a | AGCCTGCCACAGGGCCCTTT | 37 | 10050 | 10069 | 339 |
| 413348 | n/a | n/a | AGGACAGGGCAGACACACCT | 44 | 10396 | 10415 | 340 |
| 413349 | n/a | n/a | GATTTGTACTTGAATCCAGG | 34 | 10703 | 10722 | 341 |
| 413350 | n/a | n/a | ACACGCAGACCAGGACAGCT | 46 | 10747 | 10766 | 342 |
| 413351 | n/a | n/a | TTTGGATAGTCGATTTACCA | 41 | 10943 | 10962 | 343 |
| 413352 | n/a | n/a | AAGATTCATAACTATATCTA | 6 | 11045 | 11064 | 344 |
| 413353 | n/a | n/a | AAAAACATGACAGCCAGGGT | 31 | 11558 | 11577 | 345 |
| 413354 | n/a | n/a | GACTTCCCTTCACAGAATCC | 5 | 11983 | 12002 | 346 |
| 413355 | n/a | n/a | CAGGCAGGTGTCAGAGGGCT | 21 | 12250 | 12269 | 347 |
| 413356 | n/a | n/a | TAGCCTGGCTTTGATAACCC | 42 | 12892 | 12911 | 348 |
| 413357 | n/a | n/a | CATAGGCCAGGAGGAAGAGT | 35 | 13206 | 13225 | 349 |
| 413358 | n/a | n/a | TTGCTTAAACAGATAAGCAC | 17 | 13541 | 13560 | 350 |
| 413359 | n/a | n/a | AATGTCACAAGTTCACAAAC | 4 | 14428 | 14447 | 351 |
| 413360 | n/a | n/a | CTGACCTCAGGGTGATCAAG | 31 | 14721 | 14740 | 352 |
| 413361 | n/a | n/a | CCAAGCAGGAGCTGGACAGA | 19 | 15143 | 15162 | 353 |
| 413362 | n/a | n/a | TCATTTCATAGATGAGGAGA | 34 | 15215 | 15234 | 354 |
| 413363 | n/a | n/a | AGGAGTTTGTGTTTCCCATT | 39 | 15320 | 15339 | 355 |
| 413364 | n/a | n/a | GGCAGGGCTTAGAATGGCTA | 48 | 15359 | 15378 | 356 |
| 413365 | n/a | n/a | ACCATTTTCACAAGGAGAAG | 30 | 15572 | 15591 | 357 |
| 413366 | n/a | n/a | TTCAAAAAGTAGCTACTGCA | 47 | 15738 | 15757 | 358 |
| 413367 | n/a | n/a | TCCAGGACCCTGGACATGAT | 50 | 15813 | 15832 | 359 |
| 413368 | n/a | n/a | AGAGCCAGCACACAGCTATG | 20 | 16251 | 16270 | 360 |

TABLE 5-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413369 | n/a | n/a | AGTCTAGTTGGAAAAGTAGA | 16 | 16545 | 16564 | 361 |
| 413370 | n/a | n/a | AGATGCCACTTCATCAAGGC | 24 | 17722 | 17741 | 362 |
| 413371 | n/a | n/a | GAAGTCAGGCCAAGTGCCAA | 26 | 17744 | 17763 | 363 |
| 413372 | n/a | n/a | TGATTCTTACCTGCAATGAG | 22 | 18221 | 18240 | 364 |
| 413373 | n/a | n/a | CCAAGTAAGCCTCGGTGTCC | 32 | 18329 | 18348 | 365 |
| 413374 | n/a | n/a | TGAGTAGTCAAAGGTGGCTT | 30 | 19019 | 19038 | 366 |
| 413375 | n/a | n/a | ATGCCTGAGGGCAGCAGTGT | 45 | 19907 | 19926 | 367 |
| 413376 | n/a | n/a | TGACCAGGAAGGCCACACCT | 15 | 19967 | 19986 | 368 |
| 413377 | n/a | n/a | GGCTTCACCGTCCCACAGCA | 39 | 20409 | 20428 | 369 |
| 413378 | n/a | n/a | CAGGACTTGGTACCTGATTC | 35 | 20883 | 20902 | 370 |
| 413379 | n/a | n/a | TGGCTGGGAGGAGTCCAGCA | 10 | 21131 | 21150 | 371 |
| 413380 | n/a | n/a | GGGTCAAGGTCACTCAGCCA | 33 | 21660 | 21679 | 372 |
| 413381 | n/a | n/a | TATTTGAAGATAAAGTCAGA | 0 | 22021 | 22040 | 373 |
| 413382 | n/a | n/a | GGGATGATAAACACTAAGGT | 37 | 22093 | 22112 | 374 |
| 217328 | 938 | 957 | GCATTGCCACTCCCATTCTT | 59 | 38091 | 38110 | 144 |
| 413306 | 1992 | 2011 | CTGGAGGCCAGTCCAGGCTC | 23 | 41963 | 41982 | 299 |
| 413307 | 1995 | 2014 | ATCCTGGAGGCCAGTCCAGG | 18 | 41966 | 41985 | 300 |
| 413308 | 2006 | 2025 | CCCCCATCCTCATCCTGGAG | 7 | 41977 | 41996 | 301 |
| 413309 | 2010 | 2029 | GCCACCCCCATCCTCATCCT | 0 | 41981 | 42000 | 302 |
| 413310 | 2014 | 2033 | CATTGCCACCCCCATCCTCA | 9 | 41985 | 42004 | 303 |
| 413311 | 2040 | 2059 | GGGCAGTCCTTTCCCCTGCA | 37 | 42011 | 42030 | 304 |
| 413312 | 2081 | 2100 | TAGCTCATGGTGGCGGCATC | 35 | 42052 | 42071 | 305 |
| 413313 | 2087 | 2106 | TCCACCTAGCTCATGGTGGC | 21 | 42058 | 42077 | 306 |
| 413314 | 2091 | 2110 | TTACTCCACCTAGCTCATGG | 6 | 42062 | 42081 | 307 |
| 413315 | 2099 | 2118 | AAAACCAGTTACTCCACCTA | 0 | 42070 | 42089 | 308 |
| 413316 | 2102 | 2121 | AGAAAAACCAGTTACTCCAC | 4 | 42073 | 42092 | 309 |
| 413317 | 2113 | 2132 | TCAGCCACCCAAGAAAAACC | 0 | 42084 | 42103 | 310 |
| 413318 | 2120 | 2139 | CATGTCATCAGCCACCCAAG | 16 | 42091 | 42110 | 311 |
| 413319 | 2128 | 2147 | GCTGCATCCATGTCATCAGC | 43 | 42099 | 42118 | 154 |
| 413320 | 2131 | 2150 | TGTGCTGCATCCATGTCATC | 36 | 42102 | 42121 | 312 |
| 413321 | 2136 | 2155 | GAGTCTGTGCTGCATCCATG | 48 | 42107 | 42126 | 313 |
| 413322 | 2143 | 2162 | CAAGGCTGAGTCTGTGCTGC | 24 | 42114 | 42133 | 314 |
| 413323 | 2146 | 2165 | GGCCAAGGCTGAGTCTGTGC | 17 | 42117 | 42136 | 315 |
| 413324 | 2149 | 2168 | CCAGGCCAAGGCTGAGTCTG | 27 | 42120 | 42139 | 316 |
| 413325 | 2182 | 2201 | AAGGTAAACTGAGGCCACCA | 37 | 42153 | 42172 | 317 |

TABLE 5-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413326 | 2185 | 2204 | GGGAAGGTAAACTGAGGCCA | 32 | 42156 | 42175 | 318 |
| 413327 | 2236 | 2255 | AGGCCCCTTCTGAAGAGGGA | 43 | 42207 | 42226 | 319 |
| 413328 | 2239 | 2258 | GCCAGGCCCCTTCTGAAGAG | 36 | 42210 | 42229 | 320 |
| 413329 | 2242 | 2261 | AAGGCCAGGCCCCTTCTGAA | 32 | 42213 | 42232 | 321 |
| 413330 | 2246 | 2265 | TCAGAAGGCCAGGCCCCTTC | 20 | 42217 | 42236 | 322 |
| 413331 | 2252 | 2271 | TGCTGCTCAGAAGGCCAGGC | 42 | 42223 | 42242 | 323 |
| 413332 | 2257 | 2276 | TAATCTGCTGCTCAGAAGGC | 36 | 42228 | 42247 | 324 |
| 413333 | 2265 | 2284 | TTTGGAACTAATCTGCTGCT | 50 | 42236 | 42255 | 325 |
| 413334 | 2274 | 2293 | GCCACCTGCTTTGGAACTAA | 41 | 42245 | 42264 | 326 |
| 413335 | 2301 | 2320 | ACAGAAAAGTGAGGCTTGGG | 40 | 42272 | 42291 | 327 |
| 413336 | 2304 | 2323 | GGCACAGAAAAGTGAGGCTT | 32 | 42275 | 42294 | 328 |
| 413337 | 2307 | 2326 | GAAGGCACAGAAAAGTGAGG | 11 | 42278 | 42297 | 329 |
| 413338 | 2310 | 2329 | CAGGAAGGCACAGAAAAGTG | 28 | 42281 | 42300 | 330 |
| 413339 | 2313 | 2332 | CCTCAGGAAGGCACAGAAAA | 40 | 42284 | 42303 | 331 |
| 413340 | 2317 | 2336 | ACCCCCTCAGGAAGGCACAG | 25 | 42288 | 42307 | 332 |
| 413341 | 2323 | 2342 | GGCCCAACCCCCTCAGGAAG | 19 | 42294 | 42313 | 333 |
| 413342 | 2373 | 2392 | TCTCATCAAGAGATAACAGA | 6 | 42344 | 42363 | 334 |
| 413343 | 2376 | 2395 | TGATCTCATCAAGAGATAAC | 17 | 42347 | 42366 | 335 |
| 413344 | 2399 | 2418 | TACAAAAGTCTGACATGGTG | 40 | 42370 | 42389 | 336 |
| 413345 | 2402 | 2421 | ATATACAAAAGTCTGACATG | 21 | 42373 | 42392 | 337 |
| 413346 | 2406 | 2425 | AGGCATATACAAAAGTCTGA | 38 | 42377 | 42396 | 338 |

TABLE 6

Inhibition of DGAT2 mRNA by 5-10-5 MOE
gapmers targeting SEQ ID NO: 1 and 2

| ISIS NO | SEQ ID NO: 2 Start Site | SEQ ID NO: 2 Stop Site | Sequence | % inhibition | SEQ ID NO |
|---|---|---|---|---|---|
| 413383 | 22161 | 22180 | ACCCAGAGATGGTGATAAGG | 53 | 375 |
| 413384 | 22521 | 22540 | AAGTGAACCCTCACTTCCCA | 35 | 376 |
| 413385 | 22840 | 22859 | ACATATCCCCAACTGAAACA | 21 | 377 |
| 413386 | 22849 | 22868 | TCACTGATGACATATCCCCA | 52 | 378 |
| 413387 | 22862 | 22881 | GAGTATAGAAATTTCACTGA | 44 | 379 |
| 413388 | 22877 | 22896 | TGCAGCTTGGAGGAGGAGTA | 36 | 380 |
| 413389 | 23153 | 23172 | GCATTTTAACAAGATCCCCA | 34 | 381 |
| 413390 | 23167 | 23186 | CTGAATCAAAATCTGCATTT | 28 | 382 |

TABLE 6-continued

Inhibition of DGAT2 mRNA by 5-10-5 MOE gapmers targeting SEQ ID NO: 1 and 2

| ISIS NO | SEQ ID NO: 2 Start Site | SEQ ID NO: 2 Stop Site | Sequence | % inhibition | SEQ ID NO |
|---|---|---|---|---|---|
| 413391 | 23182 | 23201 | TCCAGACTGGATTTACTGAA | 60 | 383 |
| 413392 | 23550 | 23569 | TTATCCTTGAGGGTCTCATA | 45 | 384 |
| 413393 | 23560 | 23579 | CATCACATGCTTATCCTTGA | 41 | 385 |
| 413394 | 23669 | 23688 | TTCCCCAGAGCAGCTCTGAG | 27 | 386 |
| 413395 | 23726 | 23745 | GCGGCAGAGCCAGGACTGAA | 35 | 387 |
| 413396 | 23812 | 23831 | GTCATCCAGTATAGCCTAAT | 44 | 388 |
| 413397 | 23956 | 23975 | TAAAGAGGCTGGGCCATAGA | 21 | 389 |
| 413398 | 24122 | 24141 | TCAAACCTAGGTTCAGACTT | 47 | 390 |
| 413399 | 24204 | 24223 | AGGAAGGAAATGCTAGGCCT | 64 | 391 |
| 413400 | 24642 | 24661 | ACAGGAAGCCTGGTGACTGC | 54 | 392 |
| 413401 | 24790 | 24809 | CAGGCAGCCTGAAGGACACT | 49 | 393 |
| 413402 | 25074 | 25093 | AGGACAGAGGTTCAACATCC | 53 | 394 |
| 413403 | 25234 | 25253 | AGACCACATGAAGTATCTAA | 50 | 395 |
| 413404 | 25376 | 25395 | GCTATAGAATCAGACAGACC | 46 | 396 |
| 413405 | 25488 | 25507 | CCTACAGCAGAGGGAAGATG | 13 | 397 |
| 413406 | 25493 | 25512 | CAGTGCCTACAGCAGAGGGA | 0 | 398 |
| 413407 | 25504 | 25523 | GATGCTGGATCCAGTGCCTA | 53 | 399 |
| 413408 | 25953 | 25972 | GTGGGAAAGGCACAGGCTTT | 53 | 400 |
| 413409 | 26393 | 26412 | GATGGCAACCTAAGGAGTGA | 37 | 401 |
| 413410 | 26893 | 26912 | GTTCTTGGGCCTAAAGGTGA | 34 | 402 |
| 413411 | 27564 | 27583 | ATTAGCAGTAGCTCAGGAGA | 48 | 403 |
| 413412 | 27677 | 27696 | CTGGTCCAGGGAGAGACCAA | 25 | 404 |
| 413413 | 27711 | 27730 | AGAGGGTTCCATGGCACAAA | 67 | 405 |
| 413414 | 28186 | 28205 | AATTTCCTTACAGGGTATTG | 46 | 406 |
| 413415 | 28461 | 28480 | TCATGAGAAGCTTAGAAGGC | 58 | 407 |
| 413416 | 28524 | 28543 | CAACAGGCTCTGGTTCCATG | 56 | 408 |
| 413417 | 28920 | 28939 | CAGGCCCCACTGCTTAGAGG | 48 | 409 |
| 413418 | 29446 | 29465 | AAATGGTAGCCCCTTGTTGC | 32 | 410 |
| 413419 | 29503 | 29522 | TTTCCCATGGGAGAAGATAA | 55 | 411 |
| 413420 | 30361 | 30380 | AGCGCAGAGCCCATCAGCCT | 48 | 412 |
| 413421 | 30620 | 30639 | CAGGGTGACTTTGCCCCATT | 43 | 413 |
| 413422 | 30974 | 30993 | TGGCACTAAGCTAGGCACAC | 62 | 414 |
| 413423 | 31184 | 31203 | AGGGAGGCCTTGCACTTACC | 13 | 415 |
| 413424 | 31240 | 31259 | TGAGGCCCTTCAGCTTGTGC | 49 | 416 |
| 413425 | 31370 | 31389 | AAACCCTCGACTGAGTGTGA | 37 | 417 |

TABLE 6-continued

Inhibition of DGAT2 mRNA by 5-10-5 MOE gapmers targeting SEQ ID NO: 1 and 2

| ISIS NO | SEQ ID NO: 2 Start Site | SEQ ID NO: 2 Stop Site | Sequence | % inhibition | SEQ ID NO |
|---|---|---|---|---|---|
| 413426 | 31531 | 31550 | CCTTCCAGGGAATAAAATAC | 3 | 418 |
| 413427 | 31534 | 31553 | CCACCTTCCAGGGAATAAAA | 22 | 419 |
| 413428 | 31537 | 31556 | CTGCCACCTTCCAGGGAATA | 27 | 420 |
| 413429 | 31620 | 31639 | AACACTCACAGCACTTTACC | 4 | 421 |
| 413430 | 31769 | 31788 | TGGATACTCAGAAGAGCAGT | 37 | 422 |
| 413431 | 31935 | 31954 | CAGAGTTATCCTCAATTCAC | 34 | 423 |
| 413432 | 32145 | 32164 | ACACCAGGATCTCAGTCACT | 42 | 424 |
| 413433 | 32431 | 32450 | GCCTGGACAAGTCCTGCCCA | 70 | 425 |
| 413434 | 32528 | 32547 | GAAACAGGCAGTAGGAAATC | 23 | 426 |
| 413435 | 32644 | 32663 | ATGGAGTGACAGGGCAGGAA | 59 | 427 |
| 413436 | 32939 | 32958 | AGGCCACAGTGGCAACAGAG | 54 | 428 |
| 413437 | 33067 | 33086 | GTTCTTTTGGAAGGGTGGAG | 52 | 429 |
| 413438 | 33164 | 33183 | GGAGCCCTCACAGGGCCAGG | 38 | 430 |
| 413439 | 33364 | 33383 | GGACAGGAGGGTCACACACA | 45 | 431 |
| 413440 | 33671 | 33690 | AGATGGACAGGTGATTCTAA | 50 | 432 |
| 413441 | 33739 | 33758 | TTAAGCTTTGTGACCTTGGG | 67 | 433 |
| 413442 | 34101 | 34120 | GGGAAGGATACCGCCAATGA | 57 | 434 |
| 413443 | 34311 | 34330 | CAGTGGGCCCCAGGTGGCTC | 46 | 435 |
| 413444 | 34642 | 34661 | GGTGGGAAACTTGGAAACTT | 37 | 436 |
| 413445 | 35355 | 35374 | ACAATTCCTGGATAACAAGG | 41 | 437 |
| 413446 | 35362 | 35381 | TAGAAATACAATTCCTGGAT | 71 | 438 |
| 413447 | 35568 | 35587 | TGTCCTTATCAAAATCCCTC | 38 | 439 |
| 413448 | 36267 | 36286 | GCTGAGAGAGACAATGAGTA | 54 | 440 |
| 413449 | 36858 | 36877 | GATTATTCTAAAACTCAAAT | 0 | 441 |
| 413450 | 37202 | 37221 | ACCAGCTGCAAGGATGACCT | 49 | 442 |
| 413451 | 37457 | 37476 | GAGGCTCAGGCCTTGACAAC | 12 | 443 |
| 413452 | 37604 | 37623 | TGTTATCCGAGTTGAATTCT | 45 | 444 |
| 413453 | 37818 | 37837 | GTTTTGGGAACTCATGCATT | 50 | 445 |
| 413454 | 37837 | 37856 | CAGCTAATGATACAAGGTTG | 55 | 446 |
| 413455 | 37880 | 37899 | GCTATTCATTTTTCTGAGCC | 47 | 447 |
| 217328 | 38091 | 38110 | GCATTGCCACTCCCATTCTT | 67 | 144 |
| 413456 | 39033 | 39052 | AGAGGCCCTGGACACTGGCC | 32 | 448 |
| 413457 | 39040 | 39059 | TCAGCCTAGAGGCCCTGGAC | 26 | 449 |
| 413458 | 39300 | 39319 | CCAACAGTGGTGATGGGCTT | 60 | 450 |
| 413459 | 39305 | 39324 | GCTTACCAACAGTGGTGATG | 21 | 451 |

Example 2: Antisense Inhibition of Human Diacylglycerol Acyltransferase 2 in HepG2 Cells by MOE Gapmers Antisense oligonucleotides were designed targeting a diacylglycerol acyltransferase 2 (DGAT2) nucleic acid and were tested for their effects on DGAT2 mRNA in vitro. The antisense oligonucleotides were tested in a series of experiments that had similar culture conditions. The results for each experiment are presented in separate tables shown below. Cultured HepG2 cells at a density of 10,000 cells per well were transfected using Lipofectin reagent with 120 nM antisense oligonucleotide. After a treatment period of approximately 24 hours, RNA was isolated from the cells and DGAT2 mRNA levels were measured by quantitative real-time PCR. Human primer probe set RTS2988_MGB (forward sequence AACTGGCCCTGCGTCATG, designated herein as SEQ ID NO: 7; reverse sequence CTTGTACACTTCATTCTCTCCAAAGG, designated herein as SEQ ID NO: 8; probe sequence CTGACCTGGTTCCC, designated herein as SEQ ID NO: 9) was used to measure mRNA levels. DGAT2 mRNA levels were adjusted according to total RNA content, as measured by RIBOGREEN®. Results are presented as percent inhibition of DGAT2, relative to untreated control cells.

ISIS oligonucleotides from an earlier published application, WO 2005/019418, were also included in this assay. These ISIS oligonucleotides are ISIS 217316, ISIS 217317, ISIS 217328, ISIS 217329, ISIS 334177, ISIS 334178, ISIS 366730, ISIS 366731, and ISIS 369255. As shown in the Tables below, several newly designed antisense oligonucleotides demonstrated similar or greater potency that any of these benchmark oligonucleotides.

The newly designed chimeric antisense oligonucleotides in the Tables below were designed as 5-10-5 MOE, 3-14-3 MOE, or 2-13-5 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 3-14-3 MOE gapmers are 20 nucleosides in length, wherein the central gap segment comprises of fourteen 2'-deoxynucleosides and is flanked by wing segments on the 5' direction and the 3' direction comprising three nucleosides each. The 2-13-5 MOE gapmers are 20 nucleosides in length, wherein the central gap segment comprises of thirteen 2'-deoxynucleosides and is flanked by wing segments on the 5' direction and the 3' direction comprising two and three nucleosides respectively. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the Tables below is targeted to either the human DGAT2 mRNA, designated herein as SEQ ID NO: 1 (RefSeq No. NM_032564.3) or the human DGAT2 genomic sequence, designated herein as SEQ ID NO: 2 (RefSeq No. NT_033927.5 truncated from nucleotides 5669186 to 5712008). 'n/a' indicates that the antisense oligonucleotide does not target that particular gene sequence with 100% complementarity.

TABLE 8

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423460 | n/a | n/a | 5-10-5 | TGGACAAGTCCTGCCCATCT | 72 | 32428 | 32447 | 464 |
| 423520 | n/a | n/a | 3-14-3 | TGGACAAGTCCTGCCCATCT | 69 | 32428 | 32447 | 464 |
| 423598 | n/a | n/a | 2-13-5 | TGGACAAGTCCTGCCCATCT | 51 | 32428 | 32447 | 464 |
| 423461 | n/a | n/a | 5-10-5 | CTGGACAAGTCCTGCCCATC | 77 | 32429 | 32448 | 465 |
| 423521 | n/a | n/a | 3-14-3 | CTGGACAAGTCCTGCCCATC | 67 | 32429 | 32448 | 465 |
| 423599 | n/a | n/a | 2-13-5 | CTGGACAAGTCCTGCCCATC | 58 | 32429 | 32448 | 465 |
| 423462 | n/a | n/a | 5-10-5 | CCTGGACAAGTCCTGCCCAT | 73 | 32430 | 32449 | 466 |
| 423522 | n/a | n/a | 3-14-3 | CCTGGACAAGTCCTGCCCAT | 70 | 32430 | 32449 | 466 |
| 423600 | n/a | n/a | 2-13-5 | CCTGGACAAGTCCTGCCCAT | 59 | 32430 | 32449 | 466 |
| 413433 | n/a | n/a | 5-10-5 | GCCTGGACAAGTCCTGCCCA | 86 | 32431 | 32450 | 425 |
| 423523 | n/a | n/a | 3-14-3 | GCCTGGACAAGTCCTGCCCA | 84 | 32431 | 32450 | 425 |
| 423601 | n/a | n/a | 2-13-5 | GCCTGGACAAGTCCTGCCCA | 78 | 32431 | 32450 | 425 |
| 423463 | n/a | n/a | 5-10-5 | AGCCTGGACAAGTCCTGCCC | 79 | 32432 | 32451 | 467 |
| 423524 | n/a | n/a | 3-14-3 | AGCCTGGACAAGTCCTGCCC | 82 | 32432 | 32451 | 467 |
| 423602 | n/a | n/a | 2-13-5 | AGCCTGGACAAGTCCTGCCC | 75 | 32432 | 32451 | 467 |

TABLE 8-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423464 | n/a | n/a | 5-10-5 | CAGCCTGGACAAGTCCTGCC | 84 | 32433 | 32452 | 468 |
| 423525 | n/a | n/a | 3-14-3 | CAGCCTGGACAAGTCCTGCC | 72 | 32433 | 32452 | 468 |
| 423603 | n/a | n/a | 2-13-5 | CAGCCTGGACAAGTCCTGCC | 72 | 32433 | 32452 | 468 |
| 423465 | n/a | n/a | 5-10-5 | GCAGCCTGGACAAGTCCTGC | 70 | 32434 | 32453 | 469 |
| 423526 | n/a | n/a | 3-14-3 | GCAGCCTGGACAAGTCCTGC | 83 | 32434 | 32453 | 469 |
| 423604 | n/a | n/a | 2-13-5 | GCAGCCTGGACAAGTCCTGC | 77 | 32434 | 32453 | 469 |
| 423466 | n/a | n/a | 5-10-5 | TGCAGCCTGGACAAGTCCTG | 67 | 32435 | 32454 | 470 |
| 423527 | n/a | n/a | 3-14-3 | TGCAGCCTGGACAAGTCCTG | 77 | 32435 | 32454 | 470 |
| 413191 | 467 | 486 | 5-10-5 | CACTGGAGCACTGAGATGAC | 48 | 25593 | 25612 | 181 |
| 423502 | 467 | 486 | 3-14-3 | CACTGGAGCACTGAGATGAC | 55 | 25593 | 25612 | 181 |
| 423580 | 467 | 486 | 2-13-5 | CACTGGAGCACTGAGATGAC | 61 | 25593 | 25612 | 181 |
| 423449 | 468 | 487 | 5-10-5 | CCACTGGAGCACTGAGATGA | 71 | 25594 | 25613 | 452 |
| 423503 | 468 | 487 | 3-14-3 | CCACTGGAGCACTGAGATGA | 62 | 25594 | 25613 | 452 |
| 423581 | 468 | 487 | 2-13-5 | CCACTGGAGCACTGAGATGA | 54 | 25594 | 25613 | 452 |
| 423450 | 469 | 488 | 5-10-5 | CCCACTGGAGCACTGAGATG | 78 | 25595 | 25614 | 453 |
| 423504 | 469 | 488 | 3-14-3 | CCCACTGGAGCACTGAGATG | 75 | 25595 | 25614 | 453 |
| 423582 | 469 | 488 | 2-13-5 | CCCACTGGAGCACTGAGATG | 70 | 25595 | 25614 | 453 |
| 334178 | 470 | 489 | 5-10-5 | ACCCACTGGAGCACTGAGAT | 72 | 25596 | 25615 | 454 |
| 423505 | 470 | 489 | 3-14-3 | ACCCACTGGAGCACTGAGAT | 59 | 25596 | 25615 | 454 |
| 423583 | 470 | 489 | 2-13-5 | ACCCACTGGAGCACTGAGAT | 52 | 25596 | 25615 | 454 |
| 423451 | 471 | 490 | 5-10-5 | GACCCACTGGAGCACTGAGA | 69 | 25597 | 25616 | 455 |
| 423506 | 471 | 490 | 3-14-3 | GACCCACTGGAGCACTGAGA | 56 | 25597 | 25616 | 455 |
| 423584 | 471 | 490 | 2-13-5 | GACCCACTGGAGCACTGAGA | 70 | 25597 | 25616 | 455 |
| 423452 | 472 | 491 | 5-10-5 | GGACCCACTGGAGCACTGAG | 84 | 25598 | 25617 | 456 |
| 423507 | 472 | 491 | 3-14-3 | GGACCCACTGGAGCACTGAG | 82 | 25598 | 25617 | 456 |
| 423585 | 472 | 491 | 2-13-5 | GGACCCACTGGAGCACTGAG | 86 | 25598 | 25617 | 456 |
| 413192 | 473 | 492 | 5-10-5 | AGGACCCACTGGAGCACTGA | 70 | 25599 | 25618 | 182 |
| 423508 | 473 | 492 | 3-14-3 | AGGACCCACTGGAGCACTGA | 82 | 25599 | 25618 | 182 |
| 423586 | 473 | 492 | 2-13-5 | AGGACCCACTGGAGCACTGA | 75 | 25599 | 25618 | 182 |
| 423453 | 474 | 493 | 5-10-5 | CAGGACCCACTGGAGCACTG | 80 | 25600 | 25619 | 457 |
| 423509 | 474 | 493 | 3-14-3 | CAGGACCCACTGGAGCACTG | 71 | 25600 | 25619 | 457 |
| 423587 | 474 | 493 | 2-13-5 | CAGGACCCACTGGAGCACTG | 78 | 25600 | 25619 | 457 |
| 423454 | 475 | 494 | 5-10-5 | ACAGGACCCACTGGAGCACT | 79 | 25601 | 25620 | 458 |
| 423510 | 475 | 494 | 3-14-3 | ACAGGACCCACTGGAGCACT | 61 | 25601 | 25620 | 458 |
| 423588 | 475 | 494 | 2-13-5 | ACAGGACCCACTGGAGCACT | 68 | 25601 | 25620 | 458 |
| 413193 | 476 | 495 | 5-10-5 | GACAGGACCCACTGGAGCAC | 69 | 25602 | 25621 | 183 |

TABLE 8-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423511 | 476 | 495 | 3-14-3 | GACAGGACCCACTGGAGCAC | 58 | 25602 | 25621 | 183 |
| 423589 | 476 | 495 | 2-13-5 | GACAGGACCCACTGGAGCAC | 73 | 25602 | 25621 | 183 |
| 413212 | 625 | 644 | 5-10-5 | TTCGGACCCACTGTGACCTC | 75 | 31557 | 31576 | 202 |
| 423512 | 625 | 644 | 3-14-3 | TTCGGACCCACTGTGACCTC | 64 | 31557 | 31576 | 202 |
| 423590 | 625 | 644 | 2-13-5 | TTCGGACCCACTGTGACCTC | 71 | 31557 | 31576 | 202 |
| 423455 | 626 | 645 | 5-10-5 | TTTCGGACCCACTGTGACCT | 65 | 31558 | 31577 | 459 |
| 423513 | 626 | 645 | 3-14-3 | TTTCGGACCCACTGTGACCT | 61 | 31558 | 31577 | 459 |
| 423591 | 626 | 645 | 2-13-5 | TTTCGGACCCACTGTGACCT | 68 | 31558 | 31577 | 459 |
| 423456 | 627 | 646 | 5-10-5 | GTTTCGGACCCACTGTGACC | 65 | 31559 | 31578 | 460 |
| 423514 | 627 | 646 | 3-14-3 | GTTTCGGACCCACTGTGACC | 71 | 31559 | 31578 | 460 |
| 423592 | 627 | 646 | 2-13-5 | GTTTCGGACCCACTGTGACC | 70 | 31559 | 31578 | 460 |
| 423457 | 628 | 647 | 5-10-5 | AGTTTCGGACCCACTGTGAC | 63 | 31560 | 31579 | 461 |
| 423515 | 628 | 647 | 3-14-3 | AGTTTCGGACCCACTGTGAC | 60 | 31560 | 31579 | 461 |
| 423593 | 628 | 647 | 2-13-5 | AGTTTCGGACCCACTGTGAC | 64 | 31560 | 31579 | 461 |
| 413213 | 629 | 648 | 5-10-5 | CAGTTTCGGACCCACTGTGA | 74 | 31561 | 31580 | 203 |
| 423516 | 629 | 648 | 3-14-3 | CAGTTTCGGACCCACTGTGA | 58 | 31561 | 31580 | 203 |
| 423594 | 629 | 648 | 2-13-5 | CAGTTTCGGACCCACTGTGA | 77 | 31561 | 31580 | 203 |
| 423458 | 630 | 649 | 5-10-5 | CCAGTTTCGGACCCACTGTG | 83 | 31562 | 31581 | 462 |
| 423517 | 630 | 649 | 3-14-3 | CCAGTTTCGGACCCACTGTG | 82 | 31562 | 31581 | 462 |
| 423595 | 630 | 649 | 2-13-5 | CCAGTTTCGGACCCACTGTG | 80 | 31562 | 31581 | 462 |
| 423459 | 631 | 650 | 5-10-5 | CCCAGTTTCGGACCCACTGT | 85 | 31563 | 31582 | 463 |
| 423518 | 631 | 650 | 3-14-3 | CCCAGTTTCGGACCCACTGT | 76 | 31563 | 31582 | 463 |
| 423596 | 631 | 650 | 2-13-5 | CCCAGTTTCGGACCCACTGT | 70 | 31563 | 31582 | 463 |
| 413214 | 632 | 651 | 5-10-5 | GCCCAGTTTCGGACCCACTG | 89 | 31564 | 31583 | 204 |
| 423519 | 632 | 651 | 3-14-3 | GCCCAGTTTCGGACCCACTG | 81 | 31564 | 31583 | 204 |
| 423597 | 632 | 651 | 2-13-5 | GCCCAGTTTCGGACCCACTG | 82 | 31564 | 31583 | 204 |
| 217328 | 938 | 957 | 5-10-5 | GCATTGCCACTCCCATTCTT | 82 | 38091 | 38110 | 144 |

TABLE 9

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 334177 | 275 | 294 | 5-10-5 | AGGACCCCGGAGTAGGCGGC | 76 | 9896 | 9915 | 145 |
| 423528 | 275 | 294 | 3-14-3 | AGGACCCCGGAGTAGGCGGC | 76 | 9896 | 9915 | 145 |
| 423606 | 275 | 294 | 2-13-5 | AGGACCCCGGAGTAGGCGGC | 81 | 9896 | 9915 | 145 |

TABLE 9-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423467 | 276 | 295 | 5-10-5 | CAGGACCCCGGAGTAGGCGG | 75 | 9897 | 9916 | 471 |
| 423529 | 276 | 295 | 3-14-3 | CAGGACCCCGGAGTAGGCGG | 53 | 9897 | 9916 | 471 |
| 423607 | 276 | 295 | 2-13-5 | CAGGACCCCGGAGTAGGCGG | 76 | 9897 | 9916 | 471 |
| 423468 | 277 | 296 | 5-10-5 | GCAGGACCCCGGAGTAGGCG | 58 | 9898 | 9917 | 472 |
| 423530 | 277 | 296 | 3-14-3 | GCAGGACCCCGGAGTAGGCG | 70 | 9898 | 9917 | 472 |
| 423608 | 277 | 296 | 2-13-5 | GCAGGACCCCGGAGTAGGCG | 68 | 9898 | 9917 | 472 |
| 381726 | 278 | 297 | 5-10-5 | CGCAGGACCCCGGAGTAGGC | 70 | 9899 | 9918 | 38 |
| 423531 | 278 | 297 | 3-14-3 | CGCAGGACCCCGGAGTAGGC | 65 | 9899 | 9918 | 38 |
| 423609 | 278 | 297 | 2-13-5 | CGCAGGACCCCGGAGTAGGC | 71 | 9899 | 9918 | 38 |
| 423469 | 279 | 298 | 5-10-5 | GCGCAGGACCCCGGAGTAGG | 79 | 9900 | 9919 | 473 |
| 423532 | 279 | 298 | 3-14-3 | GCGCAGGACCCCGGAGTAGG | 71 | 9900 | 9919 | 473 |
| 423610 | 279 | 298 | 2-13-5 | GCGCAGGACCCCGGAGTAGG | 72 | 9900 | 9919 | 473 |
| 423470 | 280 | 299 | 5-10-5 | CGCGCAGGACCCCGGAGTAG | 74 | 9901 | 9920 | 474 |
| 423533 | 280 | 299 | 3-14-3 | CGCGCAGGACCCCGGAGTAG | 69 | 9901 | 9920 | 474 |
| 423611 | 280 | 299 | 2-13-5 | CGCGCAGGACCCCGGAGTAG | 67 | 9901 | 9920 | 474 |
| 423471 | 281 | 300 | 5-10-5 | CCGCGCAGGACCCCGGAGTA | 75 | 9902 | 9921 | 475 |
| 423534 | 281 | 300 | 3-14-3 | CCGCGCAGGACCCCGGAGTA | 71 | 9902 | 9921 | 475 |
| 411873 | 686 | 705 | 5-10-5 | TTGTGTGTCTTCACCAGCTG | 73 | 37214 | 37233 | 46 |
| 423542 | 686 | 705 | 3-14-3 | TTGTGTGTCTTCACCAGCTG | 60 | 37214 | 37233 | 46 |
| 423620 | 686 | 705 | 2-13-5 | TTGTGTGTCTTCACCAGCTG | 71 | 37214 | 37233 | 46 |
| 411898 | 687 | 706 | 5-10-5 | GTTGTGTGTCTTCACCAGCT | 68 | 37215 | 37234 | 61 |
| 423543 | 687 | 706 | 3-14-3 | GTTGTGTGTCTTCACCAGCT | 56 | 37215 | 37234 | 61 |
| 423621 | 687 | 706 | 2-13-5 | GTTGTGTGTCTTCACCAGCT | 65 | 37215 | 37234 | 61 |
| 217316 | 688 | 707 | 5-10-5 | GGTTGTGTGTCTTCACCAGC | 70 | 37216 | 37235 | 20 |
| 423544 | 688 | 707 | 3-14-3 | GGTTGTGTGTCTTCACCAGC | 70 | 37216 | 37235 | 20 |
| 423622 | 688 | 707 | 2-13-5 | GGTTGTGTGTCTTCACCAGC | 68 | 37216 | 37235 | 20 |
| 381727 | 689 | 708 | 5-10-5 | AGGTTGTGTGTCTTCACCAG | 74 | 37217 | 37236 | 39 |
| 423545 | 689 | 708 | 3-14-3 | AGGTTGTGTGTCTTCACCAG | 61 | 37217 | 37236 | 39 |
| 423623 | 689 | 708 | 2-13-5 | AGGTTGTGTGTCTTCACCAG | 61 | 37217 | 37236 | 39 |
| 411899 | 690 | 709 | 5-10-5 | CAGGTTGTGTGTCTTCACCA | 76 | 37218 | 37237 | 62 |
| 423546 | 690 | 709 | 3-14-3 | CAGGTTGTGTGTCTTCACCA | 68 | 37218 | 37237 | 62 |
| 423624 | 690 | 709 | 2-13-5 | CAGGTTGTGTGTCTTCACCA | 62 | 37218 | 37237 | 62 |
| 411874 | 691 | 710 | 5-10-5 | GCAGGTTGTGTGTCTTCACC | 73 | 37219 | 37238 | 47 |
| 423547 | 691 | 710 | 3-14-3 | GCAGGTTGTGTGTCTTCACC | 69 | 37219 | 37238 | 47 |
| 423625 | 691 | 710 | 2-13-5 | GCAGGTTGTGTGTCTTCACC | 56 | 37219 | 37238 | 47 |
| 411900 | 692 | 711 | 5-10-5 | AGCAGGTTGTGTGTCTTCAC | 77 | 37220 | 37239 | 63 |

TABLE 9-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423548 | 692 | 711 | 3-14-3 | AGCAGGTTGTGTGTCTTCAC | 63 | 37220 | 37239 | 63 |
| 423626 | 692 | 711 | 2-13-5 | AGCAGGTTGTGTGTCTTCAC | 44 | 37220 | 37239 | 63 |
| 217317 | 693 | 712 | 5-10-5 | CAGCAGGTTGTGTGTCTTCA | 75 | 37221 | 37240 | 21 |
| 423549 | 693 | 712 | 3-14-3 | CAGCAGGTTGTGTGTCTTCA | 47 | 37221 | 37240 | 21 |
| 423627 | 693 | 712 | 2-13-5 | CAGCAGGTTGTGTGTCTTCA | 57 | 37221 | 37240 | 21 |
| 381728 | 694 | 713 | 5-10-5 | TCAGCAGGTTGTGTGTCTTC | 56 | 37222 | 37241 | 40 |
| 423550 | 694 | 713 | 3-14-3 | TCAGCAGGTTGTGTGTCTTC | 54 | 37222 | 37241 | 40 |
| 423628 | 694 | 713 | 2-13-5 | TCAGCAGGTTGTGTGTCTTC | 57 | 37222 | 37241 | 40 |
| 411901 | 695 | 714 | 5-10-5 | GTCAGCAGGTTGTGTGTCTT | 59 | 37223 | 37242 | 64 |
| 423551 | 695 | 714 | 3-14-3 | GTCAGCAGGTTGTGTGTCTT | 61 | 37223 | 37242 | 64 |
| 423629 | 695 | 714 | 2-13-5 | GTCAGCAGGTTGTGTGTCTT | 58 | 37223 | 37242 | 64 |
| 411875 | 696 | 715 | 5-10-5 | GGTCAGCAGGTTGTGTGTCT | 62 | 37224 | 37243 | 48 |
| 423552 | 696 | 715 | 3-14-3 | GGTCAGCAGGTTGTGTGTCT | 57 | 37224 | 37243 | 48 |
| 423630 | 696 | 715 | 2-13-5 | GGTCAGCAGGTTGTGTGTCT | 45 | 37224 | 37243 | 48 |
| 411902 | 697 | 716 | 5-10-5 | TGGTCAGCAGGTTGTGTGTC | 43 | 37225 | 37244 | 65 |
| 423553 | 697 | 716 | 3-14-3 | TGGTCAGCAGGTTGTGTGTC | 57 | 37225 | 37244 | 65 |
| 423631 | 697 | 716 | 2-13-5 | TGGTCAGCAGGTTGTGTGTC | 57 | 37225 | 37244 | 65 |
| 413231 | 814 | 833 | 5-10-5 | GGTAAGGCCGTATGCCTGGG | 71 | 37342 | 37361 | 221 |
| 423535 | 814 | 833 | 3-14-3 | GGTAAGGCCGTATGCCTGGG | 51 | 37342 | 37361 | 221 |
| 423613 | 814 | 833 | 2-13-5 | GGTAAGGCCGTATGCCTGGG | 53 | 37342 | 37361 | 221 |
| 423472 | 815 | 834 | 5-10-5 | AGGTAAGGCCGTATGCCTGG | 72 | 37343 | 37362 | 476 |
| 423536 | 815 | 834 | 3-14-3 | AGGTAAGGCCGTATGCCTGG | 67 | 37343 | 37362 | 476 |
| 423614 | 815 | 834 | 2-13-5 | AGGTAAGGCCGTATGCCTGG | 63 | 37343 | 37362 | 476 |
| 423473 | 816 | 835 | 5-10-5 | CAGGTAAGGCCGTATGCCTG | 63 | 37344 | 37363 | 477 |
| 423537 | 816 | 835 | 3-14-3 | CAGGTAAGGCCGTATGCCTG | 72 | 37344 | 37363 | 477 |
| 423615 | 816 | 835 | 2-13-5 | CAGGTAAGGCCGTATGCCTG | 59 | 37344 | 37363 | 477 |
| 413232 | 817 | 836 | 5-10-5 | CCAGGTAAGGCCGTATGCCT | 76 | 37345 | 37364 | 225 |
| 423538 | 817 | 836 | 3-14-3 | CCAGGTAAGGCCGTATGCCT | 71 | 37345 | 37364 | 225 |
| 423616 | 817 | 836 | 2-13-5 | CCAGGTAAGGCCGTATGCCT | 64 | 37345 | 37364 | 225 |
| 423474 | 818 | 837 | 5-10-5 | GCCAGGTAAGGCCGTATGCC | 68 | 37346 | 37365 | 478 |
| 423539 | 818 | 837 | 3-14-3 | GCCAGGTAAGGCCGTATGCC | 61 | 37346 | 37365 | 478 |
| 423617 | 818 | 837 | 2-13-5 | GCCAGGTAAGGCCGTATGCC | 66 | 37346 | 37365 | 478 |
| 423475 | 819 | 838 | 5-10-5 | AGCCAGGTAAGGCCGTATGC | 70 | 37347 | 37366 | 479 |
| 423540 | 819 | 838 | 3-14-3 | AGCCAGGTAAGGCCGTATGC | 51 | 37347 | 37366 | 479 |
| 423618 | 819 | 838 | 2-13-5 | AGCCAGGTAAGGCCGTATGC | 67 | 37347 | 37366 | 479 |
| 413233 | 820 | 839 | 5-10-5 | TAGCCAGGTAAGGCCGTATG | 60 | 37348 | 37367 | 226 |

TABLE 9-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423541 | 820 | 839 | 3-14-3 | TAGCCAGGTAAGGCCGTATG | 49 | 37348 | 37367 | 226 |
| 423619 | 820 | 839 | 2-13-5 | TAGCCAGGTAAGGCCGTATG | 51 | 37348 | 37367 | 226 |
| 217328 | 938 | 957 | 5-10-5 | GCATTGCCACTCCCATTCTT | 82 | 38091 | 38110 | 144 |

TABLE 10

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 413251 | 935 | 954 | 5-10-5 | TTGCCACTCCCATTCTTTGA | 57 | 38088 | 38107 | 244 |
| 423476 | 935 | 954 | 3-14-3 | TTGCCACTCCCATTCTTTGA | 59 | 38088 | 38107 | 244 |
| 423554 | 935 | 954 | 2-13-5 | TTGCCACTCCCATTCTTTGA | 57 | 38088 | 38107 | 244 |
| 423435 | 936 | 955 | 5-10-5 | ATTGCCACTCCCATTCTTTG | 35 | 38089 | 38108 | 480 |
| 423477 | 936 | 955 | 3-14-3 | ATTGCCACTCCCATTCTTTG | 40 | 38089 | 38108 | 480 |
| 423555 | 936 | 955 | 2-13-5 | ATTGCCACTCCCATTCTTTG | 53 | 38089 | 38108 | 480 |
| 423436 | 937 | 956 | 5-10-5 | CATTGCCACTCCCATTCTTT | 44 | 38090 | 38109 | 481 |
| 423478 | 937 | 956 | 3-14-3 | CATTGCCACTCCCATTCTTT | 46 | 38090 | 38109 | 481 |
| 423556 | 937 | 956 | 2-13-5 | CATTGCCACTCCCATTCTTT | 40 | 38090 | 38109 | 481 |
| 217328 | 938 | 957 | 5-10-5 | GCATTGCCACTCCCATTCTT | 85 | 38091 | 38110 | 144 |
| 423479 | 938 | 957 | 3-14-3 | GCATTGCCACTCCCATTCTT | 85 | 38091 | 38110 | 144 |
| 423557 | 938 | 957 | 2-13-5 | GCATTGCCACTCCCATTCTT | 61 | 38091 | 38110 | 144 |
| 380133 | 939 | 958 | 5-10-5 | AGCATTGCCACTCCCATTCT | 74 | 38092 | 38111 | 482 |
| 423480 | 939 | 958 | 3-14-3 | AGCATTGCCACTCCCATTCT | 67 | 38092 | 38111 | 482 |
| 423558 | 939 | 958 | 2-13-5 | AGCATTGCCACTCCCATTCT | 50 | 38092 | 38111 | 482 |
| 423437 | 940 | 959 | 5-10-5 | TAGCATTGCCACTCCCATTC | 71 | 38093 | 38112 | 483 |
| 423481 | 940 | 959 | 3-14-3 | TAGCATTGCCACTCCCATTC | 68 | 38093 | 38112 | 483 |
| 423559 | 940 | 959 | 2-13-5 | TAGCATTGCCACTCCCATTC | 60 | 38093 | 38112 | 483 |
| 423438 | 941 | 960 | 5-10-5 | ATAGCATTGCCACTCCCATT | 57 | 38094 | 38113 | 484 |
| 423482 | 941 | 960 | 3-14-3 | ATAGCATTGCCACTCCCATT | 71 | 38094 | 38113 | 484 |
| 423560 | 941 | 960 | 2-13-5 | ATAGCATTGCCACTCCCATT | 57 | 38094 | 38113 | 484 |
| 423439 | 942 | 961 | 5-10-5 | GATAGCATTGCCACTCCCAT | 66 | 38095 | 38114 | 485 |
| 423483 | 942 | 961 | 3-14-3 | GATAGCATTGCCACTCCCAT | 75 | 38095 | 38114 | 485 |
| 423561 | 942 | 961 | 2-13-5 | GATAGCATTGCCACTCCCAT | 62 | 38095 | 38114 | 485 |
| 217329 | 943 | 962 | 5-10-5 | TGATAGCATTGCCACTCCCA | 64 | 38096 | 38115 | 486 |
| 423484 | 943 | 962 | 3-14-3 | TGATAGCATTGCCACTCCCA | 66 | 38096 | 38115 | 486 |

TABLE 10-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423562 | 943 | 962 | 2-13-5 | TGATAGCATTGCCACTCCCA | 69 | 38096 | 38115 | 486 |
| 413252 | 976 | 995 | 5-10-5 | TCAGAGACTCAGCCGCACCC | 55 | 38129 | 38148 | 245 |
| 423485 | 976 | 995 | 3-14-3 | TCAGAGACTCAGCCGCACCC | 41 | 38129 | 38148 | 245 |
| 423563 | 976 | 995 | 2-13-5 | TCAGAGACTCAGCCGCACCC | 56 | 38129 | 38148 | 245 |
| 423440 | 977 | 996 | 5-10-5 | CTCAGAGACTCAGCCGCACC | 80 | 38130 | 38149 | 487 |
| 423486 | 977 | 996 | 3-14-3 | CTCAGAGACTCAGCCGCACC | 70 | 38130 | 38149 | 487 |
| 423564 | 977 | 996 | 2-13-5 | CTCAGAGACTCAGCCGCACC | 43 | 38130 | 38149 | 487 |
| 423441 | 978 | 997 | 5-10-5 | GCTCAGAGACTCAGCCGCAC | 86 | 38131 | 38150 | 488 |
| 423487 | 978 | 997 | 3-14-3 | GCTCAGAGACTCAGCCGCAC | 69 | 38131 | 38150 | 488 |
| 423565 | 978 | 997 | 2-13-5 | GCTCAGAGACTCAGCCGCAC | 82 | 38131 | 38150 | 488 |
| 366730 | 979 | 998 | 5-10-5 | AGCTCAGAGACTCAGCCGCA | 85 | 38132 | 38151 | 150 |
| 423488 | 979 | 998 | 3-14-3 | AGCTCAGAGACTCAGCCGCA | 77 | 38132 | 38151 | 150 |
| 423566 | 979 | 998 | 2-13-5 | AGCTCAGAGACTCAGCCGCA | 86 | 38132 | 38151 | 150 |
| 423442 | 980 | 999 | 5-10-5 | GAGCTCAGAGACTCAGCCGC | 81 | 38133 | 38152 | 489 |
| 423489 | 980 | 999 | 3-14-3 | GAGCTCAGAGACTCAGCCGC | 89 | 38133 | 38152 | 489 |
| 423567 | 980 | 999 | 2-13-5 | GAGCTCAGAGACTCAGCCGC | 89 | 38133 | 38152 | 489 |
| 423443 | 981 | 1000 | 5-10-5 | GGAGCTCAGAGACTCAGCCG | 73 | 38134 | 38153 | 490 |
| 423490 | 981 | 1000 | 3-14-3 | GGAGCTCAGAGACTCAGCCG | 81 | 38134 | 38153 | 490 |
| 423568 | 981 | 1000 | 2-13-5 | GGAGCTCAGAGACTCAGCCG | 65 | 38134 | 38153 | 490 |
| 423444 | 982 | 1001 | 5-10-5 | TGGAGCTCAGAGACTCAGCC | 77 | 38135 | 38154 | 153 |
| 423491 | 982 | 1001 | 3-14-3 | TGGAGCTCAGAGACTCAGCC | 76 | 38135 | 38154 | 153 |
| 423569 | 982 | 1001 | 2-13-5 | TGGAGCTCAGAGACTCAGCC | 82 | 38135 | 38154 | 153 |
| 423445 | 983 | 1002 | 5-10-5 | ATGGAGCTCAGAGACTCAGC | 78 | 38136 | 38155 | 491 |
| 423492 | 983 | 1002 | 3-14-3 | ATGGAGCTCAGAGACTCAGC | 71 | 38136 | 38155 | 491 |
| 423570 | 983 | 1002 | 2-13-5 | ATGGAGCTCAGAGACTCAGC | 73 | 38136 | 38155 | 491 |
| 366731 | 984 | 1003 | 5-10-5 | CATGGAGCTCAGAGACTCAG | 65 | 38137 | 38156 | 492 |
| 423493 | 984 | 1003 | 3-14-3 | CATGGAGCTCAGAGACTCAG | 62 | 38137 | 38156 | 492 |
| 423571 | 984 | 1003 | 2-13-5 | CATGGAGCTCAGAGACTCAG | 71 | 38137 | 38156 | 492 |
| 423446 | 985 | 1004 | 5-10-5 | GCATGGAGCTCAGAGACTCA | 69 | 38138 | 38157 | 493 |
| 423494 | 985 | 1004 | 3-14-3 | GCATGGAGCTCAGAGACTCA | 51 | 38138 | 38157 | 493 |
| 423572 | 985 | 1004 | 2-13-5 | GCATGGAGCTCAGAGACTCA | 77 | 38138 | 38157 | 493 |
| 423447 | 986 | 1005 | 5-10-5 | GGCATGGAGCTCAGAGACTC | 77 | 38139 | 38158 | 494 |
| 423495 | 986 | 1005 | 3-14-3 | GGCATGGAGCTCAGAGACTC | 74 | 38139 | 38158 | 494 |
| 423573 | 986 | 1005 | 2-13-5 | GGCATGGAGCTCAGAGACTC | 77 | 38139 | 38158 | 494 |
| 413253 | 987 | 1006 | 5-10-5 | AGGCATGGAGCTCAGAGACT | 83 | 38140 | 38159 | 246 |
| 423496 | 987 | 1006 | 3-14-3 | AGGCATGGAGCTCAGAGACT | 66 | 38140 | 38159 | 246 |

TABLE 10-continued

Inhibition of DGAT2 mRNA by MOE gapmers targeting SEQ ID NO: 1 and 2

| ISIS NO | SEQ ID NO: 1 Start Site | SEQ ID NO: 1 Stop Site | Motif | Sequence | % inhibition | SEQ ID NO: 2 Start Site | SEQ ID NO: 2 Stop Site | SEQ ID NO |
|---|---|---|---|---|---|---|---|---|
| 423574 | 987 | 1006 | 2-13-5 | AGGCATGGAGCTCAGAGACT | 78 | 38140 | 38159 | 246 |
| 423448 | 988 | 1007 | 5-10-5 | CAGGCATGGAGCTCAGAGAC | 57 | 38141 | 38160 | 495 |
| 423497 | 988 | 1007 | 3-14-3 | CAGGCATGGAGCTCAGAGAC | 76 | 38141 | 38160 | 495 |
| 423575 | 988 | 1007 | 2-13-5 | CAGGCATGGAGCTCAGAGAC | 70 | 38141 | 38160 | 495 |
| 369255 | 1339 | 1358 | 5-10-5 | CCAGGGCCTCCATGTACATG | 83 | 41310 | 41329 | 103 |
| 423498 | 1339 | 1358 | 3-14-3 | CCAGGGCCTCCATGTACATG | 86 | 41310 | 41329 | 103 |
| 423576 | 1339 | 1358 | 2-13-5 | CCAGGGCCTCCATGTACATG | 69 | 41310 | 41329 | 103 |
| 411944 | 1340 | 1359 | 5-10-5 | ACCAGGGCCTCCATGTACAT | 85 | 41311 | 41330 | 120 |
| 423499 | 1340 | 1359 | 3-14-3 | ACCAGGGCCTCCATGTACAT | 84 | 41311 | 41330 | 120 |
| 423577 | 1340 | 1359 | 2-13-5 | ACCAGGGCCTCCATGTACAT | 50 | 41311 | 41330 | 120 |
| 411945 | 1341 | 1360 | 5-10-5 | CACCAGGGCCTCCATGTACA | 80 | 41312 | 41331 | 121 |
| 423500 | 1341 | 1360 | 3-14-3 | CACCAGGGCCTCCATGTACA | 41 | 41312 | 41331 | 121 |
| 423578 | 1341 | 1360 | 2-13-5 | CACCAGGGCCTCCATGTACA | 69 | 41312 | 41331 | 121 |
| 411946 | 1342 | 1361 | 5-10-5 | TCACCAGGGCCTCCATGTAC | 65 | 41313 | 41332 | 122 |
| 423501 | 1342 | 1361 | 3-14-3 | TCACCAGGGCCTCCATGTAC | 68 | 41313 | 41332 | 122 |
| 423579 | 1342 | 1361 | 2-13-5 | TCACCAGGGCCTCCATGTAC | 3 | 41313 | 41332 | 122 |

Example 3: Antisense Inhibition of Human DGAT2 in HepG2 Cells by MOE Gapmers

Antisense oligonucleotides were designed targeting a DGAT2 nucleic acid and were tested for their effects on DGAT2 mRNA in vitro. The antisense oligonucleotides were tested in a series of experiments that had similar culture conditions. Previously disclosed oligonucleotides, ISIS 217317, 217328, ISIS 366722, ISIS 366710, ISIS 366714, ISIS 366728, ISIS 366746, and ISIS 369255 were included in this study as benchmark oligonucleotides. The results for each experiment are presented in separate tables shown below. Cultured HepG2 cells at a density of 20,000 cells per well were transfected using electroporation with 4,500 nM antisense oligonucleotide. After a treatment period of approximately 24 hours, RNA was isolated from the cells and DGAT2 mRNA levels were measured by quantitative real-time PCR. Human primer probe set RTS2988_MGB was used to measure mRNA levels. The potency of some oligonucleotides was measured with human primer probe set RTS2367 (forward sequence GGCCTCCCGGAGACTGA, designated herein as SEQ ID NO: 4; reverse sequence AAGTGATTTGCAGCTGGTTCCT, designated herein as SEQ ID NO: 5; probe sequence AGGTGAACTGAGCCAGCCTTCGGG, designated herein as SEQ ID NO: 6). DGAT2 mRNA levels were adjusted according to total RNA content, as measured by RIBOGREEN®. Results are presented as percent inhibition of DGAT2, relative to untreated control cells. The results show several antisense oligonucleotides demonstrate greater potency than the benchmark oligonucleotides.

The newly designed chimeric antisense oligonucleotides in the Tables below were designed as 5-10-5 MOE gapmers. The 5-10-5 MOE gapmers are 20 nucleosides in length, wherein the central gap segment comprises often 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted in the human gene sequence. Each gapmer listed in the Tables below is targeted to SEQ ID NO: 1, SEQ ID NO: 2, or both. 'n/a' indicates that the antisense oligonucleotide does not target that particular gene sequence with 100% complementarity. In case the sequence alignment for a target gene sequence in a particular table is not shown, it is understood that none of the oligonucleotides presented in that table align with 100% complementarity with that target gene sequence.

TABLE 7

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 334177 | 9896 | 9915 | AGGACCCCGGAGTAGGCGGC | 76 | 145 |
| 366710 | 25551 | 25570 | GACCTATTGAGCCAGGTGAC | 60 | 146 |
| 366722 | 31097 | 31116 | GTGCAGAATATGTACATGAG | 50 | 148 |
| 413433 | 32431 | 32450 | GCCTGGACAAGTCCTGCCCA | 80 | 425 |
| 523014 | 35670 | 35689 | TTCTACTCAAAAATATACAT | 23 | 4084 |
| 495875 | 36249 | 36268 | TAAGGGTATTCTGCTCATAA | 73 | 2148 |
| 495876 | 36250 | 36269 | GTAAGGGTATTCTGCTCATA | 83 | 2149 |
| 495877 | 36251 | 36270 | AGTAAGGGTATTCTGCTCAT | 82 | 2150 |
| 495878 | 36252 | 36271 | GAGTAAGGGTATTCTGCTCA | 89 | 2151 |
| 523015 | 36254 | 36273 | ATGAGTAAGGGTATTCTGCT | 68 | 4085 |
| 523016 | 36255 | 36274 | AATGAGTAAGGGTATTCTGC | 65 | 4086 |
| 523017 | 36256 | 36275 | CAATGAGTAAGGGTATTCTG | 39 | 4087 |
| 523018 | 36257 | 36276 | ACAATGAGTAAGGGTATTCT | 25 | 4088 |
| 495879 | 36259 | 36278 | AGACAATGAGTAAGGGTATT | 64 | 2152 |
| 495880 | 36260 | 36279 | GAGACAATGAGTAAGGGTAT | 62 | 2153 |
| 495881 | 36261 | 36280 | AGAGACAATGAGTAAGGGTA | 64 | 2154 |
| 495882 | 36262 | 36281 | GAGAGACAATGAGTAAGGGT | 66 | 2155 |
| 523019 | 36513 | 36532 | CAGCCCTGTGCCAGCCAGCC | 37 | 4089 |
| 523020 | 36514 | 36533 | ACAGCCCTGTGCCAGCCAGC | 17 | 4090 |
| 523021 | 36515 | 36534 | GACAGCCCTGTGCCAGCCAG | 52 | 4091 |
| 523022 | 36516 | 36535 | CGACAGCCCTGTGCCAGCCA | 62 | 4092 |
| 495886 | 36518 | 36537 | AGCGACAGCCCTGTGCCAGC | 57 | 2159 |
| 495887 | 36519 | 36538 | AAGCGACAGCCCTGTGCCAG | 46 | 2160 |
| 495888 | 36520 | 36539 | CAAGCGACAGCCCTGTGCCA | 28 | 2161 |
| 495889 | 36521 | 36540 | ACAAGCGACAGCCCTGTGCC | 46 | 2162 |
| 523023 | 36579 | 36598 | ACTTTCCCACAGTCAGCTGG | 59 | 4093 |
| 523024 | 36580 | 36599 | AACTTTCCCACAGTCAGCTG | 51 | 4094 |
| 523025 | 36581 | 36600 | AAACTTTCCCACAGTCAGCT | 68 | 4095 |
| 523026 | 36582 | 36601 | GAAACTTTCCCACAGTCAGC | 73 | 4096 |
| 523027 | 36584 | 36603 | TGGAAACTTTCCCACAGTCA | 68 | 4097 |
| 523028 | 36585 | 36604 | ATGGAAACTTTCCCACAGTC | 52 | 4098 |
| 523029 | 36586 | 36605 | AATGGAAACTTTCCCACAGT | 23 | 4099 |
| 523030 | 36587 | 36606 | AAATGGAAACTTTCCCACAG | 36 | 4100 |
| 523031 | 36842 | 36861 | AAATCCAACCCTTGTCACTC | 28 | 4101 |
| 523032 | 36843 | 36862 | CAAATCCAACCCTTGTCACT | 22 | 4102 |
| 523033 | 36844 | 36863 | TCAAATCCAACCCTTGTCAC | 21 | 4103 |

TABLE 7-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 523034 | 36845 | 36864 | CTCAAATCCAACCCTTGTCA | 38 | 4104 |
| 523035 | 37120 | 37139 | TGGATGTGTCATTTCCCCTG | 69 | 4105 |
| 217328 | 38091 | 38110 | GCATTGCCACTCCCATTCTT | 73 | 144 |
| 423444 | 38135 | 38154 | TGGAGCTCAGAGACTCAGCC | 56 | 153 |
| 522979 | 39671 | 39690 | AGTGCAAGAGTTACCTCCTC | 67 | 4106 |
| 522980 | 39672 | 39691 | CAGTGCAAGAGTTACCTCCT | 67 | 4107 |
| 522981 | 39673 | 39692 | GCAGTGCAAGAGTTACCTCC | 60 | 4108 |
| 522982 | 39674 | 39693 | AGCAGTGCAAGAGTTACCTC | 63 | 4109 |
| 522983 | 39681 | 39700 | ATCAGTTAGCAGTGCAAGAG | 46 | 4110 |
| 522984 | 39682 | 39701 | TATCAGTTAGCAGTGCAAGA | 43 | 4111 |
| 522985 | 39683 | 39702 | CTATCAGTTAGCAGTGCAAG | 52 | 4112 |
| 522986 | 39684 | 39703 | CCTATCAGTTAGCAGTGCAA | 64 | 4113 |
| 522987 | 39686 | 39705 | TTCCTATCAGTTAGCAGTGC | 61 | 4114 |
| 522988 | 39687 | 39706 | ATTCCTATCAGTTAGCAGTG | 47 | 4115 |
| 522989 | 39688 | 39707 | AATTCCTATCAGTTAGCAGT | 16 | 4116 |
| 522990 | 39689 | 39708 | TAATTCCTATCAGTTAGCAG | 11 | 4117 |
| 522991 | 39814 | 39833 | TCTATGCTGCAGTCATATTA | 28 | 4118 |
| 522992 | 39815 | 39834 | GTCTATGCTGCAGTCATATT | 20 | 4119 |
| 522993 | 39816 | 39835 | GGTCTATGCTGCAGTCATAT | 45 | 4120 |
| 522994 | 39817 | 39836 | AGGTCTATGCTGCAGTCATA | 40 | 4121 |
| 522995 | 39819 | 39838 | ACAGGTCTATGCTGCAGTCA | 56 | 4122 |
| 522996 | 39820 | 39839 | GACAGGTCTATGCTGCAGTC | 70 | 4123 |
| 522997 | 39821 | 39840 | TGACAGGTCTATGCTGCAGT | 65 | 4124 |
| 522998 | 39822 | 39841 | CTGACAGGTCTATGCTGCAG | 54 | 4125 |
| 522999 | 39829 | 39848 | CACTCTTCTGACAGGTCTAT | 54 | 4126 |
| 523000 | 39830 | 39849 | CCACTCTTCTGACAGGTCTA | 70 | 4127 |
| 523001 | 39831 | 39850 | TCCACTCTTCTGACAGGTCT | 69 | 4128 |
| 523002 | 39832 | 39851 | TTCCACTCTTCTGACAGGTC | 84 | 4129 |
| 523003 | 39834 | 39853 | TTTTCCACTCTTCTGACAGG | 35 | 4130 |
| 523004 | 39835 | 39854 | GTTTTCCACTCTTCTGACAG | 25 | 4131 |
| 523005 | 39836 | 39855 | TGTTTTCCACTCTTCTGACA | 24 | 4132 |
| 523006 | 40329 | 40348 | ATCTCTTCCATCTCCACTGC | 30 | 4133 |
| 523007 | 40330 | 40349 | CATCTCTTCCATCTCCACTG | 32 | 4134 |
| 523008 | 40331 | 40350 | ACATCTCTTCCATCTCCACT | 39 | 4135 |
| 523009 | 40332 | 40351 | CACATCTCTTCCATCTCCAC | 40 | 4136 |

TABLE 7-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 523010 | 40334 | 40353 | TGCACATCTCTTCCATCTCC | 50 | 4137 |
| 523011 | 40335 | 40354 | ATGCACATCTCTTCCATCTC | 35 | 4138 |
| 523012 | 40336 | 40355 | CATGCACATCTCTTCCATCT | 43 | 4139 |
| 523013 | 40337 | 40356 | TCATGCACATCTCTTCCATC | 28 | 4140 |
| 369255 | 41310 | 41329 | CCAGGGCCTCCATGTACATG | 33 | 103 |
| 411947 | 41315 | 41334 | CTTCACCAGGGCCTCCATGT | 22 | 123 |
| 366746 | 41337 | 41356 | TGGTCTTGTGCTTGTCGAAG | 46 | 151 |

TABLE 11

Inhibition of DGAT2 mRNA by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 82 | 32431 | 32450 | 425 |
| 472154 | 105 | 124 | GACACCTGGAGCTGCGGCCG | 51 | 9726 | 9745 | 573 |
| 472155 | 106 | 125 | GGACACCTGGAGCTGCGGCC | 79 | 9727 | 9746 | 574 |
| 472156 | 107 | 126 | AGGACACCTGGAGCTGCGGC | 79 | 9728 | 9747 | 575 |
| 472157 | 108 | 127 | TAGGACACCTGGAGCTGCGG | 56 | 9729 | 9748 | 576 |
| 472158 | 110 | 129 | GCTAGGACACCTGGAGCTGC | 76 | 9731 | 9750 | 577 |
| 472159 | 111 | 130 | GGCTAGGACACCTGGAGCTG | 63 | 9732 | 9751 | 578 |
| 472160 | 161 | 180 | CAGGGCTTCGCGCAGAGCAC | 46 | 9782 | 9801 | 579 |
| 472161 | 162 | 181 | CCAGGGCTTCGCGCAGAGCA | 42 | 9783 | 9802 | 580 |
| 472162 | 164 | 183 | GGCCAGGGCTTCGCGCAGAG | 6 | 9785 | 9804 | 581 |
| 472163 | 253 | 272 | TGAGGGTCTTCATGGCTGAA | 40 | 9874 | 9893 | 582 |
| 472164 | 255 | 274 | TATGAGGGTCTTCATGGCTG | 69 | 9876 | 9895 | 583 |
| 472165 | 256 | 275 | CTATGAGGGTCTTCATGGCT | 62 | 9877 | 9896 | 584 |
| 472166 | 257 | 276 | GCTATGAGGGTCTTCATGGC | 53 | 9878 | 9897 | 585 |
| 472167 | 259 | 278 | CGGCTATGAGGGTCTTCATG | 59 | 9880 | 9899 | 586 |
| 472168 | 260 | 279 | GCGGCTATGAGGGTCTTCAT | 54 | 9881 | 9900 | 587 |
| 472169 | 261 | 280 | GGCGGCTATGAGGGTCTTCA | 57 | 9882 | 9901 | 588 |
| 472170 | 262 | 281 | AGGCGGCTATGAGGGTCTTC | 69 | 9883 | 9902 | 589 |
| 472171 | 264 | 283 | GTAGGCGGCTATGAGGGTCT | 32 | 9885 | 9904 | 590 |
| 472172 | 265 | 284 | AGTAGGCGGCTATGAGGGTC | 23 | 9886 | 9905 | 591 |
| 472173 | 267 | 286 | GGAGTAGGCGGCTATGAGGG | 15 | 9888 | 9907 | 592 |
| 472174 | 268 | 287 | CGGAGTAGGCGGCTATGAGG | 48 | 9889 | 9908 | 593 |

TABLE 11-continued

Inhibition of DGAT2 mRNA by 5-10-5 MOE
gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472175 | 270 | 289 | CCCGGAGTAGGCGGCTATGA | 80 | 9891 | 9910 | 594 |
| 472176 | 271 | 290 | CCCCGGAGTAGGCGGCTATG | 75 | 9892 | 9911 | 595 |
| 472177 | 273 | 292 | GACCCCGGAGTAGGCGGCTA | 69 | 9894 | 9913 | 596 |
| 472178 | 274 | 293 | GGACCCCGGAGTAGGCGGCT | 76 | 9895 | 9914 | 597 |
| 334177 | 275 | 294 | AGGACCCCGGAGTAGGCGGC | 74 | 9896 | 9915 | 145 |
| 472179 | 305 | 324 | CGGTCAGCCTCGGCCTGACG | 30 | 9926 | 9945 | 598 |
| 472180 | 306 | 325 | CCGGTCAGCCTCGGCCTGAC | 5 | 9927 | 9946 | 599 |
| 472181 | 308 | 327 | CTCCGGTCAGCCTCGGCCTG | 43 | 9929 | 9948 | 600 |
| 472182 | 309 | 328 | GCTCCGGTCAGCCTCGGCCT | 61 | 9930 | 9949 | 601 |
| 472183 | 311 | 330 | TGGCTCCGGTCAGCCTCGGC | 48 | 9932 | 9951 | 602 |
| 472184 | 312 | 331 | CTGGCTCCGGTCAGCCTCGG | 28 | 9933 | 9952 | 603 |
| 472185 | 313 | 332 | GCTGGCTCCGGTCAGCCTCG | 35 | 9934 | 9953 | 604 |
| 472186 | 314 | 333 | CGCTGGCTCCGGTCAGCCTC | 44 | 9935 | 9954 | 605 |
| 472187 | 315 | 334 | GCGCTGGCTCCGGTCAGCCT | 43 | 9936 | 9955 | 606 |
| 472188 | 332 | 351 | GCAGGTCCTCCGTGAGAGCG | 63 | 9953 | 9972 | 607 |
| 472189 | 333 | 352 | CGCAGGTCCTCCGTGAGAGC | 68 | 9954 | 9973 | 608 |
| 472190 | 334 | 353 | GCGCAGGTCCTCCGTGAGAG | 40 | 9955 | 9974 | 609 |
| 472191 | 335 | 354 | AGCGCAGGTCCTCCGTGAGA | 39 | 9956 | 9975 | 610 |
| 472192 | 336 | 355 | CAGCGCAGGTCCTCCGTGAG | 54 | 9957 | 9976 | 611 |
| 472193 | 337 | 356 | ACAGCGCAGGTCCTCCGTGA | 36 | 9958 | 9977 | 612 |
| 472194 | 338 | 357 | GACAGCGCAGGTCCTCCGTG | 63 | 9959 | 9978 | 613 |
| 472195 | 340 | 359 | GCGACAGCGCAGGTCCTCCG | 62 | 9961 | 9980 | 614 |
| 472196 | 341 | 360 | CGCGACAGCGCAGGTCCTCC | 65 | 9962 | 9981 | 615 |
| 472197 | 342 | 361 | GCGCGACAGCGCAGGTCCTC | 57 | 9963 | 9982 | 616 |
| 472198 | 343 | 362 | CGCGCGACAGCGCAGGTCCT | 58 | 9964 | 9983 | 617 |
| 472199 | 344 | 363 | TCGCGCGACAGCGCAGGTCC | 53 | 9965 | 9984 | 618 |
| 472200 | 345 | 364 | CTCGCGCGACAGCGCAGGTC | 52 | 9966 | 9985 | 619 |
| 472201 | 346 | 365 | CCTCGCGCGACAGCGCAGGT | 26 | 9967 | 9986 | 620 |
| 472202 | 347 | 366 | CCCTCGCGCGACAGCGCAGG | 32 | 9968 | 9987 | 621 |
| 472203 | 349 | 368 | ACCCCTCGCGCGACAGCGCA | 67 | 9970 | 9989 | 622 |
| 472204 | 350 | 369 | GACCCCTCGCGCGACAGCGC | 72 | 9971 | 9990 | 623 |
| 472205 | 351 | 370 | AGACCCCTCGCGCGACAGCG | 74 | 9972 | 9991 | 624 |
| 472206 | 352 | 371 | CAGACCCCTCGCGCGACAGC | 67 | 9973 | 9992 | 625 |
| 472207 | 353 | 372 | CCAGACCCCTCGCGCGACAG | 53 | 9974 | 9993 | 626 |
| 472208 | 354 | 373 | CCCAGACCCCTCGCGCGACA | 70 | 9975 | 9994 | 627 |

TABLE 11-continued

Inhibition of DGAT2 mRNA by 5-10-5 MOE
gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472209 | 356 | 375 | CTCCCAGACCCCTCGCGCGA | 50 | 9977 | 9996 | 628 |
| 472210 | 357 | 376 | TCTCCCAGACCCCTCGCGCG | 31 | 9978 | 9997 | 629 |
| 472211 | 358 | 377 | ATCTCCCAGACCCCTCGCGC | 54 | 9979 | 9998 | 630 |
| 472212 | 359 | 378 | CATCTCCCAGACCCCTCGCG | 51 | 9980 | 9999 | 631 |
| 472213 | 360 | 379 | CCATCTCCCAGACCCCTCGC | 42 | 9981 | 10000 | 632 |
| 472214 | 362 | 381 | CCCCATCTCCCAGACCCCTC | 48 | 9983 | 10002 | 633 |
| 472215 | 363 | 382 | GCCCCATCTCCCAGACCCCT | 32 | n/a | n/a | 634 |
| 472216 | 364 | 383 | TGCCCCATCTCCCAGACCCC | 46 | n/a | n/a | 635 |
| 472217 | 365 | 384 | GTGCCCCATCTCCCAGACCC | 43 | n/a | n/a | 636 |
| 472218 | 366 | 385 | AGTGCCCCATCTCCCAGACC | 19 | n/a | n/a | 637 |
| 472219 | 368 | 387 | CCAGTGCCCCATCTCCCAGA | 9 | n/a | n/a | 638 |
| 472220 | 369 | 388 | TCCAGTGCCCCATCTCCCAG | 0 | n/a | n/a | 639 |
| 472221 | 371 | 390 | GATCCAGTGCCCCATCTCCC | 0 | n/a | n/a | 640 |
| 472222 | 372 | 391 | GGATCCAGTGCCCCATCTCC | 2 | n/a | n/a | 641 |
| 472223 | 374 | 393 | CTGGATCCAGTGCCCCATCT | 31 | n/a | n/a | 642 |
| 472224 | 375 | 394 | GCTGGATCCAGTGCCCCATC | 39 | n/a | n/a | 643 |
| 472225 | 377 | 396 | ATGCTGGATCCAGTGCCCCA | 36 | n/a | n/a | 644 |
| 472226 | 378 | 397 | GATGCTGGATCCAGTGCCCC | 18 | n/a | n/a | 645 |
| 472227 | 380 | 399 | AGGATGCTGGATCCAGTGCC | 41 | 25506 | 25525 | 646 |
| 472228 | 381 | 400 | GAGGATGCTGGATCCAGTGC | 17 | 25507 | 25526 | 647 |
| 472229 | 383 | 402 | GAGAGGATGCTGGATCCAGT | 6 | 25509 | 25528 | 648 |

TABLE 12

Inhibition of DGAT2 mRNA by 5-10-5 MOE
gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 75 | 32431 | 32450 | 425 |
| 472373 | 782 | 801 | ACTTCTGTGGCCTCTGTGCT | 31 | 37310 | 37329 | 649 |
| 472374 | 784 | 803 | TCACTTCTGTGGCCTCTGTG | 42 | 37312 | 37331 | 650 |
| 472375 | 785 | 804 | CTCACTTCTGTGGCCTCTGT | 53 | 37313 | 37332 | 651 |
| 472376 | 787 | 806 | TGCTCACTTCTGTGGCCTCT | 66 | 37315 | 37334 | 652 |
| 472377 | 788 | 807 | TTGCTCACTTCTGTGGCCTC | 78 | 37316 | 37335 | 653 |
| 472378 | 790 | 809 | TCTTGCTCACTTCTGTGGCC | 57 | 37318 | 37337 | 654 |
| 472379 | 791 | 810 | TTCTTGCTCACTTCTGTGGC | 43 | 37319 | 37338 | 655 |

TABLE 12-continued

Inhibition of DGAT2 mRNA by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472380 | 793 | 812 | ACTTCTTGCTCACTTCTGTG | 41 | 37321 | 37340 | 656 |
| 472381 | 794 | 813 | AACTTCTTGCTCACTTCTGT | 14 | 37322 | 37341 | 657 |
| 472382 | 796 | 815 | GGAACTTCTTGCTCACTTCT | 39 | 37324 | 37343 | 658 |
| 472383 | 797 | 816 | GGGAACTTCTTGCTCACTTC | 47 | 37325 | 37344 | 659 |
| 472384 | 799 | 818 | CTGGGAACTTCTTGCTCACT | 65 | 37327 | 37346 | 660 |
| 472385 | 800 | 819 | CCTGGGAACTTCTTGCTCAC | 0 | 37328 | 37347 | 661 |
| 472386 | 802 | 821 | TGCCTGGGAACTTCTTGCTC | 54 | 37330 | 37349 | 662 |
| 472387 | 803 | 822 | ATGCCTGGGAACTTCTTGCT | 24 | 37331 | 37350 | 663 |
| 472388 | 805 | 824 | GTATGCCTGGGAACTTCTTG | 26 | 37333 | 37352 | 664 |
| 472389 | 806 | 825 | CGTATGCCTGGGAACTTCTT | 46 | 37334 | 37353 | 665 |
| 472390 | 807 | 826 | CCGTATGCCTGGGAACTTCT | 41 | 37335 | 37354 | 666 |
| 472391 | 809 | 828 | GGCCGTATGCCTGGGAACTT | 47 | 37337 | 37356 | 667 |
| 472392 | 810 | 829 | AGGCCGTATGCCTGGGAACT | 45 | 37338 | 37357 | 668 |
| 472393 | 812 | 831 | TAAGGCCGTATGCCTGGGAA | 38 | 37340 | 37359 | 669 |
| 472394 | 813 | 832 | GTAAGGCCGTATGCCTGGGA | 53 | 37341 | 37360 | 670 |
| 472395 | 821 | 840 | GTAGCCAGGTAAGGCCGTAT | 53 | 37349 | 37368 | 671 |
| 472396 | 822 | 841 | TGTAGCCAGGTAAGGCCGTA | 41 | 37350 | 37369 | 672 |
| 472397 | 824 | 843 | AGTGTAGCCAGGTAAGGCCG | 36 | 37352 | 37371 | 673 |
| 472398 | 825 | 844 | CAGTGTAGCCAGGTAAGGCC | 63 | 37353 | 37372 | 674 |
| 472399 | 826 | 845 | CCAGTGTAGCCAGGTAAGGC | 45 | 37354 | 37373 | 675 |
| 472400 | 862 | 881 | GGTACTCCCTCAACACAGGC | 42 | 37390 | 37409 | 676 |
| 472401 | 863 | 882 | AGGTACTCCCTCAACACAGG | 11 | 37391 | 37410 | 677 |
| 472402 | 865 | 884 | TCAGGTACTCCCTCAACACA | 20 | 37393 | 37412 | 678 |
| 472403 | 866 | 885 | ATCAGGTACTCCCTCAACAC | 13 | 37394 | 37413 | 679 |
| 472404 | 868 | 887 | ACATCAGGTACTCCCTCAAC | 11 | 37396 | 37415 | 680 |
| 472405 | 869 | 888 | GACATCAGGTACTCCCTCAA | 27 | 37397 | 37416 | 681 |
| 472406 | 871 | 890 | CAGACATCAGGTACTCCCTC | 39 | 37399 | 37418 | 682 |
| 472407 | 872 | 891 | CCAGACATCAGGTACTCCCT | 46 | 37400 | 37419 | 683 |
| 472408 | 873 | 892 | TCCAGACATCAGGTACTCCC | 32 | 37401 | 37420 | 684 |
| 472409 | 874 | 893 | CTCCAGACATCAGGTACTCC | 29 | 37402 | 37421 | 685 |
| 472410 | 879 | 898 | GATACCTCCAGACATCAGGT | 33 | n/a | n/a | 686 |
| 472411 | 880 | 899 | AGATACCTCCAGACATCAGG | 17 | n/a | n/a | 687 |
| 472412 | 882 | 901 | GCAGATACCTCCAGACATCA | 9 | n/a | n/a | 688 |
| 472413 | 883 | 902 | GGCAGATACCTCCAGACATC | 44 | n/a | n/a | 689 |
| 472414 | 885 | 904 | AGGGCAGATACCTCCAGACA | 0 | n/a | n/a | 690 |

TABLE 12-continued

Inhibition of DGAT2 mRNA by 5-10-5 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472415 | 886 | 905 | CAGGGCAGATACCTCCAGAC | 16 | n/a | n/a | 691 |
| 472416 | 888 | 907 | GACAGGGCAGATACCTCCAG | 1 | n/a | n/a | 692 |
| 472417 | 889 | 908 | TGACAGGGCAGATACCTCCA | 31 | n/a | n/a | 693 |
| 472418 | 911 | 930 | AAATAGTCTATGGTGTCCCG | 25 | 38064 | 38083 | 694 |
| 472419 | 912 | 931 | CAAATAGTCTATGGTGTCCC | 32 | 38065 | 38084 | 695 |
| 472420 | 914 | 933 | AGCAAATAGTCTATGGTGTC | 54 | 38067 | 38086 | 696 |
| 472421 | 915 | 934 | AAGCAAATAGTCTATGGTGT | 22 | 38068 | 38087 | 697 |
| 472422 | 917 | 936 | GAAAGCAAATAGTCTATGGT | 24 | 38070 | 38089 | 698 |
| 472423 | 918 | 937 | TGAAAGCAAATAGTCTATGG | 19 | 38071 | 38090 | 699 |
| 472424 | 920 | 939 | TTTGAAAGCAAATAGTCTAT | 17 | 38073 | 38092 | 700 |
| 472425 | 921 | 940 | CTTTGAAAGCAAATAGTCTA | 0 | 38074 | 38093 | 701 |
| 472426 | 923 | 942 | TTCTTTGAAAGCAAATAGTC | 24 | 38076 | 38095 | 702 |
| 472427 | 924 | 943 | ATTCTTTGAAAGCAAATAGT | 9 | 38077 | 38096 | 703 |
| 472428 | 926 | 945 | CCATTCTTTGAAAGCAAATA | 31 | 38079 | 38098 | 704 |
| 472429 | 927 | 946 | CCCATTCTTTGAAAGCAAAT | 48 | 38080 | 38099 | 705 |
| 380132 | 929 | 948 | CTCCCATTCTTTGAAAGCAA | 75 | 38082 | 38101 | 706 |
| 472430 | 930 | 949 | ACTCCCATTCTTTGAAAGCA | 35 | 38083 | 38102 | 707 |
| 472431 | 931 | 950 | CACTCCCATTCTTTGAAAGC | 35 | 38084 | 38103 | 708 |
| 472432 | 933 | 952 | GCCACTCCCATTCTTTGAAA | 69 | 38086 | 38105 | 709 |
| 472433 | 934 | 953 | TGCCACTCCCATTCTTTGAA | 73 | 38087 | 38106 | 710 |
| 217328 | 938 | 957 | GCATTGCCACTCCCATTCTT | 76 | 38091 | 38110 | 144 |
| 472434 | 944 | 963 | ATGATAGCATTGCCACTCCC | 65 | 38097 | 38116 | 711 |
| 472435 | 945 | 964 | GATGATAGCATTGCCACTCC | 50 | 38098 | 38117 | 712 |
| 472436 | 946 | 965 | TGATGATAGCATTGCCACTC | 56 | 38099 | 38118 | 713 |
| 380134 | 947 | 966 | ATGATGATAGCATTGCCACT | 34 | 38100 | 38119 | 714 |
| 472437 | 949 | 968 | CGATGATGATAGCATTGCCA | 56 | 38102 | 38121 | 715 |
| 472438 | 950 | 969 | ACGATGATGATAGCATTGCC | 51 | 38103 | 38122 | 716 |
| 472439 | 951 | 970 | CACGATGATGATAGCATTGC | 56 | 38104 | 38123 | 717 |
| 472440 | 952 | 971 | CCACGATGATGATAGCATTG | 63 | 38105 | 38124 | 718 |
| 472441 | 974 | 993 | AGAGACTCAGCCGCACCCCC | 63 | 38127 | 38146 | 719 |
| 472442 | 975 | 994 | CAGAGACTCAGCCGCACCCC | 66 | 38128 | 38147 | 720 |
| 366730 | 979 | 998 | AGCTCAGAGACTCAGCCGCA | 67 | 38132 | 38151 | 150 |
| 423442 | 980 | 999 | GAGCTCAGAGACTCAGCCGC | 52 | 38133 | 38152 | 489 |
| 423444 | 982 | 1001 | TGGAGCTCAGAGACTCAGCC | 63 | 38135 | 38154 | 153 |
| 472443 | 989 | 1008 | CCAGGCATGGAGCTCAGAGA | 47 | 38142 | 38161 | 721 |

TABLE 13

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 94 | 32431 | 32450 | 425 |
| 472230 | 384 | 403 | GGAGAGGATGCTGGATCCAG | 38 | 25510 | 25529 | 722 |
| 472231 | 386 | 405 | GCGGAGAGGATGCTGGATCC | 41 | 25512 | 25531 | 723 |
| 472232 | 387 | 406 | GGCGGAGAGGATGCTGGATC | 28 | 25513 | 25532 | 724 |
| 472233 | 389 | 408 | AGGGCGGAGAGGATGCTGGA | 0 | 25515 | 25534 | 725 |
| 472234 | 390 | 409 | GAGGGCGGAGAGGATGCTGG | 66 | 25516 | 25535 | 726 |
| 472235 | 391 | 410 | GGAGGGCGGAGAGGATGCTG | 28 | 25517 | 25536 | 727 |
| 472236 | 392 | 411 | TGGAGGGCGGAGAGGATGCT | 35 | 25518 | 25537 | 728 |
| 472237 | 394 | 413 | CCTGGAGGGCGGAGAGGATG | 9 | 25520 | 25539 | 729 |
| 472238 | 395 | 414 | TCCTGGAGGGCGGAGAGGAT | 0 | 25521 | 25540 | 730 |
| 472239 | 397 | 416 | GGTCCTGGAGGGCGGAGAGG | 0 | 25523 | 25542 | 731 |
| 472240 | 398 | 417 | AGGTCCTGGAGGGCGGAGAG | 32 | 25524 | 25543 | 732 |
| 472241 | 399 | 418 | GAGGTCCTGGAGGGCGGAGA | 33 | 25525 | 25544 | 733 |
| 472242 | 400 | 419 | AGAGGTCCTGGAGGGCGGAG | 0 | 25526 | 25545 | 734 |
| 472243 | 401 | 420 | AAGAGGTCCTGGAGGGCGGA | 35 | 25527 | 25546 | 735 |
| 472244 | 402 | 421 | GAAGAGGTCCTGGAGGGCGG | 16 | 25528 | 25547 | 736 |
| 472245 | 403 | 422 | AGAAGAGGTCCTGGAGGGCG | 53 | 25529 | 25548 | 737 |
| 366710 | 425 | 444 | GACCTATTGAGCCAGGTGAC | 62 | 25551 | 25570 | 146 |
| 472246 | 426 | 445 | GGACCTATTGAGCCAGGTGA | 63 | 25552 | 25571 | 738 |
| 472247 | 427 | 446 | TGGACCTATTGAGCCAGGTG | 58 | 25553 | 25572 | 739 |
| 472248 | 428 | 447 | TTGGACCTATTGAGCCAGGT | 71 | 25554 | 25573 | 740 |
| 472249 | 429 | 448 | CTTGGACCTATTGAGCCAGG | 63 | 25555 | 25574 | 741 |
| 472250 | 431 | 450 | ACCTTGGACCTATTGAGCCA | 80 | 25557 | 25576 | 742 |
| 472251 | 432 | 451 | CACCTTGGACCTATTGAGCC | 70 | 25558 | 25577 | 743 |
| 472252 | 433 | 452 | CCACCTTGGACCTATTGAGC | 74 | 25559 | 25578 | 744 |
| 472253 | 434 | 453 | TCCACCTTGGACCTATTGAG | 68 | 25560 | 25579 | 745 |
| 472254 | 436 | 455 | TTTCCACCTTGGACCTATTG | 41 | 25562 | 25581 | 746 |
| 472255 | 437 | 456 | TTTTCCACCTTGGACCTATT | 43 | 25563 | 25582 | 747 |
| 472256 | 438 | 457 | CTTTTCCACCTTGGACCTAT | 48 | 25564 | 25583 | 748 |
| 472257 | 439 | 458 | GCTTTTCCACCTTGGACCTA | 75 | 25565 | 25584 | 749 |
| 472258 | 441 | 460 | CTGCTTTTCCACCTTGGACC | 83 | 25567 | 25586 | 750 |
| 472259 | 442 | 461 | GCTGCTTTTCCACCTTGGAC | 83 | 25568 | 25587 | 751 |
| 472260 | 443 | 462 | AGCTGCTTTTCCACCTTGGA | 84 | 25569 | 25588 | 152 |
| 472261 | 444 | 463 | TAGCTGCTTTTCCACCTTGG | 76 | 25570 | 25589 | 752 |
| 366714 | 445 | 464 | GTAGCTGCTTTTCCACCTTG | 70 | 25571 | 25590 | 147 |
| 472262 | 446 | 465 | TGTAGCTGCTTTTCCACCTT | 39 | 25572 | 25591 | 753 |

TABLE 13-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472263 | 447 | 466 | CTGTAGCTGCTTTTCCACCT | 72 | 25573 | 25592 | 754 |
| 380086 | 449 | 468 | ACCTGTAGCTGCTTTTCCAC | 70 | 25575 | 25594 | 755 |
| 472264 | 450 | 469 | GACCTGTAGCTGCTTTTCCA | 77 | 25576 | 25595 | 756 |
| 472265 | 452 | 471 | ATGACCTGTAGCTGCTTTTC | 57 | 25578 | 25597 | 757 |
| 472266 | 453 | 472 | GATGACCTGTAGCTGCTTTT | 74 | 25579 | 25598 | 758 |
| 472267 | 454 | 473 | AGATGACCTGTAGCTGCTTT | 67 | 25580 | 25599 | 759 |
| 472268 | 456 | 475 | TGAGATGACCTGTAGCTGCT | 77 | 25582 | 25601 | 760 |
| 472269 | 457 | 476 | CTGAGATGACCTGTAGCTGC | 78 | 25583 | 25602 | 761 |
| 472270 | 459 | 478 | CACTGAGATGACCTGTAGCT | 80 | 25585 | 25604 | 762 |
| 472271 | 460 | 479 | GCACTGAGATGACCTGTAGC | 77 | 25586 | 25605 | 763 |
| 472272 | 462 | 481 | GAGCACTGAGATGACCTGTA | 71 | 25588 | 25607 | 764 |
| 472273 | 463 | 482 | GGAGCACTGAGATGACCTGT | 75 | 25589 | 25608 | 765 |
| 472274 | 465 | 484 | CTGGAGCACTGAGATGACCT | 72 | 25591 | 25610 | 766 |
| 472275 | 466 | 485 | ACTGGAGCACTGAGATGACC | 62 | 25592 | 25611 | 767 |
| 423453 | 474 | 493 | CAGGACCCACTGGAGCACTG | 92 | 25600 | 25619 | 457 |
| 472276 | 477 | 496 | GGACAGGACCCACTGGAGCA | 72 | 25603 | 25622 | 768 |
| 472277 | 478 | 497 | AGGACAGGACCCACTGGAGC | 74 | 25604 | 25623 | 769 |
| 472278 | 480 | 499 | GAAGGACAGGACCCACTGGA | 53 | 25606 | 25625 | 770 |
| 472279 | 481 | 500 | GGAAGGACAGGACCCACTGG | 48 | 25607 | 25626 | 771 |
| 472280 | 483 | 502 | AAGGAAGGACAGGACCCACT | 54 | 25609 | 25628 | 772 |
| 472281 | 484 | 503 | CAAGGAAGGACAGGACCCAC | 40 | 25610 | 25629 | 773 |
| 472282 | 485 | 504 | ACAAGGAAGGACAGGACCCA | 65 | 25611 | 25630 | 774 |
| 472283 | 487 | 506 | GTACAAGGAAGGACAGGACC | 55 | 25613 | 25632 | 775 |
| 472284 | 488 | 507 | AGTACAAGGAAGGACAGGAC | 35 | 25614 | 25633 | 776 |
| 472285 | 489 | 508 | CAGTACAAGGAAGGACAGGA | 40 | 25615 | 25634 | 777 |
| 472286 | 490 | 509 | CCAGTACAAGGAAGGACAGG | 32 | 25616 | 25635 | 778 |
| 472287 | 492 | 511 | TCCCAGTACAAGGAAGGACA | 58 | n/a | n/a | 779 |
| 472288 | 493 | 512 | CTCCCAGTACAAGGAAGGAC | 33 | n/a | n/a | 780 |
| 472289 | 495 | 514 | CACTCCCAGTACAAGGAAGG | 47 | n/a | n/a | 781 |
| 472290 | 496 | 515 | CCACTCCCAGTACAAGGAAG | 4 | n/a | n/a | 782 |
| 472291 | 498 | 517 | GGCCACTCCCAGTACAAGGA | 12 | n/a | n/a | 783 |
| 472292 | 499 | 518 | AGGCCACTCCCAGTACAAGG | 2 | n/a | n/a | 784 |
| 472293 | 501 | 520 | GCAGGCCACTCCCAGTACAA | 0 | n/a | n/a | 785 |
| 472294 | 502 | 521 | TGCAGGCCACTCCCAGTACA | 0 | n/a | n/a | 786 |
| 472295 | 504 | 523 | ACTGCAGGCCACTCCCAGTA | 43 | n/a | n/a | 787 |

TABLE 13-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472296 | 505 | 524 | CACTGCAGGCCACTCCCAGT | 14 | n/a | n/a | 788 |
| 472297 | 507 | 526 | GGCACTGCAGGCCACTCCCA | 73 | n/a | n/a | 789 |
| 472298 | 508 | 527 | TGGCACTGCAGGCCACTCCC | 25 | n/a | n/a | 790 |
| 472299 | 509 | 528 | ATGGCACTGCAGGCCACTCC | 46 | 31076 | 31095 | 791 |
| 472300 | 511 | 530 | GGATGGCACTGCAGGCCACT | 43 | 31078 | 31097 | 792 |
| 472301 | 512 | 531 | AGGATGGCACTGCAGGCCAC | 61 | 31079 | 31098 | 793 |
| 472302 | 513 | 532 | GAGGATGGCACTGCAGGCCA | 69 | 31080 | 31099 | 794 |

TABLE 14

Inhibition of DGAT2 mRNA by 5-10-5 MOE gapmers targeting
SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 90 | 32431 | 32450 | 425 |
| 472303 | 514 | 533 | TGAGGATGGCACTGCAGGCC | 45 | 31081 | 31100 | 795 |
| 472304 | 516 | 535 | CATGAGGATGGCACTGCAGG | 24 | 31083 | 31102 | 796 |
| 472305 | 517 | 536 | ACATGAGGATGGCACTGCAG | 19 | 31084 | 31103 | 797 |
| 472306 | 518 | 537 | TACATGAGGATGGCACTGCA | 59 | 31085 | 31104 | 798 |
| 472307 | 521 | 540 | ATGTACATGAGGATGGCACT | 32 | 31088 | 31107 | 799 |
| 472308 | 522 | 541 | TATGTACATGAGGATGGCAC | 22 | 31089 | 31108 | 800 |
| 472309 | 523 | 542 | ATATGTACATGAGGATGGCA | 39 | 31090 | 31109 | 801 |
| 472310 | 524 | 543 | AATATGTACATGAGGATGGC | 34 | 31091 | 31110 | 802 |
| 472311 | 526 | 545 | AGAATATGTACATGAGGATG | 1 | 31093 | 31112 | 803 |
| 472312 | 527 | 546 | CAGAATATGTACATGAGGAT | 48 | 31094 | 31113 | 804 |
| 472313 | 528 | 547 | GCAGAATATGTACATGAGGA | 44 | 31095 | 31114 | 805 |
| 472314 | 529 | 548 | TGCAGAATATGTACATGAGG | 43 | 31096 | 31115 | 806 |
| 366722 | 530 | 549 | GTGCAGAATATGTACATGAG | 65 | 31097 | 31116 | 148 |
| 472315 | 552 | 571 | CACAGCGATGAGCCAGCAAT | 65 | 31119 | 31138 | 807 |
| 472316 | 553 | 572 | GCACAGCGATGAGCCAGCAA | 84 | 31120 | 31139 | 808 |
| 472317 | 555 | 574 | GAGCACAGCGATGAGCCAGC | 87 | 31122 | 31141 | 809 |
| 472318 | 556 | 575 | AGAGCACAGCGATGAGCCAG | 83 | 31123 | 31142 | 810 |
| 472319 | 558 | 577 | GTAGAGCACAGCGATGAGCC | 73 | 31125 | 31144 | 811 |
| 472320 | 559 | 578 | AGTAGAGCACAGCGATGAGC | 68 | 31126 | 31145 | 812 |
| 472321 | 560 | 579 | AAGTAGAGCACAGCGATGAG | 48 | 31127 | 31146 | 813 |
| 472322 | 561 | 580 | GAAGTAGAGCACAGCGATGA | 22 | 31128 | 31147 | 814 |

TABLE 14-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472323 | 563 | 582 | GTGAAGTAGAGCACAGCGAT | 64 | 31130 | 31149 | 815 |
| 472324 | 564 | 583 | AGTGAAGTAGAGCACAGCGA | 51 | 31131 | 31150 | 816 |
| 472325 | 565 | 584 | AAGTGAAGTAGAGCACAGCG | 39 | 31132 | 31151 | 817 |
| 472326 | 566 | 585 | CAAGTGAAGTAGAGCACAGC | 26 | 31133 | 31152 | 818 |
| 472327 | 568 | 587 | GCCAAGTGAAGTAGAGCACA | 64 | 31135 | 31154 | 819 |
| 472328 | 569 | 588 | AGCCAAGTGAAGTAGAGCAC | 65 | 31136 | 31155 | 820 |
| 472329 | 571 | 590 | CCAGCCAAGTGAAGTAGAGC | 51 | 31138 | 31157 | 821 |
| 472330 | 572 | 591 | ACCAGCCAAGTGAAGTAGAG | 47 | 31139 | 31158 | 822 |
| 472331 | 574 | 593 | ACACCAGCCAAGTGAAGTAG | 35 | 31141 | 31160 | 823 |
| 472332 | 575 | 594 | AACACCAGCCAAGTGAAGTA | 34 | 31142 | 31161 | 824 |
| 472333 | 577 | 596 | CAAACACCAGCCAAGTGAAG | 33 | 31144 | 31163 | 825 |
| 472334 | 578 | 597 | TCAAACACCAGCCAAGTGAA | 34 | 31145 | 31164 | 826 |
| 472335 | 580 | 599 | AGTCAAACACCAGCCAAGTG | 39 | 31147 | 31166 | 827 |
| 472336 | 581 | 600 | CAGTCAAACACCAGCCAAGT | 37 | 31148 | 31167 | 828 |
| 472337 | 583 | 602 | TCCAGTCAAACACCAGCCAA | 53 | 31150 | 31169 | 829 |
| 472338 | 584 | 603 | TTCCAGTCAAACACCAGCCA | 52 | 31151 | 31170 | 830 |
| 472339 | 586 | 605 | TGTTCCAGTCAAACACCAGC | 38 | 31153 | 31172 | 831 |
| 472340 | 587 | 606 | GTGTTCCAGTCAAACACCAG | 43 | 31154 | 31173 | 832 |
| 472341 | 589 | 608 | GTGTGTTCCAGTCAAACACC | 26 | 31156 | 31175 | 833 |
| 472342 | 590 | 609 | GGTGTGTTCCAGTCAAACAC | 41 | 31157 | 31176 | 834 |
| 472343 | 592 | 611 | TGGGTGTGTTCCAGTCAAAC | 7 | 31159 | 31178 | 835 |
| 472344 | 593 | 612 | TTGGGTGTGTTCCAGTCAAA | 15 | 31160 | 31179 | 836 |
| 472345 | 595 | 614 | TCTTGGGTGTGTTCCAGTCA | 54 | 31162 | 31181 | 837 |
| 472346 | 596 | 615 | TTCTTGGGTGTGTTCCAGTC | 47 | 31163 | 31182 | 838 |
| 472347 | 616 | 635 | ACTGTGACCTCCTGCCACCT | 66 | 31548 | 31567 | 839 |
| 472348 | 617 | 636 | CACTGTGACCTCCTGCCACC | 55 | 31549 | 31568 | 840 |
| 472349 | 619 | 638 | CCCACTGTGACCTCCTGCCA | 79 | 31551 | 31570 | 841 |
| 472350 | 620 | 639 | ACCCACTGTGACCTCCTGCC | 77 | 31552 | 31571 | 842 |
| 472351 | 622 | 641 | GGACCCACTGTGACCTCCTG | 80 | 31554 | 31573 | 843 |
| 472352 | 623 | 642 | CGGACCCACTGTGACCTCCT | 63 | 31555 | 31574 | 844 |
| 472353 | 624 | 643 | TCGGACCCACTGTGACCTCC | 82 | 31556 | 31575 | 845 |
| 423459 | 631 | 650 | CCCAGTTTCGGACCCACTGT | 49 | 31563 | 31582 | 463 |
| 472354 | 633 | 652 | AGCCCAGTTTCGGACCCACT | 79 | 31565 | 31584 | 846 |
| 472355 | 634 | 653 | CAGCCCAGTTTCGGACCCAC | 48 | 31566 | 31585 | 847 |
| 472356 | 636 | 655 | CACAGCCCAGTTTCGGACCC | 72 | 31568 | 31587 | 848 |

TABLE 14-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472357 | 637 | 656 | ACACAGCCCAGTTTCGGACC | 63 | 31569 | 31588 | 849 |
| 472358 | 639 | 658 | CCACACAGCCCAGTTTCGGA | 75 | 31571 | 31590 | 850 |
| 472359 | 640 | 659 | GCCACACAGCCCAGTTTCGG | 74 | 31572 | 31591 | 851 |
| 472360 | 641 | 660 | CGCCACACAGCCCAGTTTCG | 77 | 31573 | 31592 | 852 |
| 472361 | 659 | 678 | AAGTAGTCTCGAAAGTAGCG | 7 | 31591 | 31610 | 853 |
| 472362 | 660 | 679 | AAAGTAGTCTCGAAAGTAGC | 0 | 31592 | 31611 | 854 |
| 472363 | 662 | 681 | GGAAAGTAGTCTCGAAAGTA | 15 | 31594 | 31613 | 855 |
| 472364 | 663 | 682 | GGGAAAGTAGTCTCGAAAGT | 0 | 31595 | 31614 | 856 |
| 472365 | 664 | 683 | TGGGAAAGTAGTCTCGAAAG | 57 | 31596 | 31615 | 857 |
| 472366 | 666 | 685 | GATGGGAAAGTAGTCTCGAA | 17 | 31598 | 31617 | 858 |
| 472367 | 667 | 686 | GGATGGGAAAGTAGTCTCGA | 21 | 31599 | 31618 | 859 |
| 411897 | 685 | 704 | TGTGTGTCTTCACCAGCTGG | 41 | n/a | n/a | 60 |
| 217317 | 693 | 712 | CAGCAGGTTGTGTGTCTTCA | 57 | 37221 | 37240 | 21 |
| 411901 | 695 | 714 | GTCAGCAGGTTGTGTGTCTT | 45 | 37223 | 37242 | 64 |
| 411902 | 697 | 716 | TGGTCAGCAGGTTGTGTGTC | 28 | 37225 | 37244 | 65 |
| 472368 | 724 | 743 | GGTGGTATCCAAAGATATAG | 50 | 37252 | 37271 | 860 |
| 472369 | 725 | 744 | GGGTGGTATCCAAAGATATA | 27 | 37253 | 37272 | 861 |
| 366728 | 757 | 776 | TGCAGAAGGCACCCAGGCCC | 63 | 37285 | 37304 | 149 |
| 472370 | 758 | 777 | TTGCAGAAGGCACCCAGGCC | 31 | 37286 | 37305 | 862 |
| 472371 | 759 | 778 | GTTGCAGAAGGCACCCAGGC | 46 | 37287 | 37306 | 863 |
| 472372 | 781 | 800 | CTTCTGTGGCCTCTGTGCTG | 33 | 37309 | 37328 | 864 |

TABLE 15

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 89 | 32431 | 32450 | 425 |
| 472521 | 1210 | 1229 | TGTCGGAGGAGAAGAGGCCT | 32 | 39257 | 39276 | 865 |
| 472522 | 1212 | 1231 | GGTGTCGGAGGAGAAGAGGC | 0 | 39259 | 39278 | 866 |
| 472523 | 1213 | 1232 | AGGTGTCGGAGGAGAAGAGG | 0 | 39260 | 39279 | 867 |
| 472524 | 1214 | 1233 | CAGGTGTCGGAGGAGAAGAG | 9 | 39261 | 39280 | 868 |
| 472525 | 1216 | 1235 | CCCAGGTGTCGGAGGAGAAG | 3 | 39263 | 39282 | 869 |
| 472526 | 1217 | 1236 | CCCCAGGTGTCGGAGGAGAA | 36 | 39264 | 39283 | 870 |
| 472527 | 1219 | 1238 | GCCCCCAGGTGTCGGAGGAG | 10 | 39266 | 39285 | 871 |

TABLE 15-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472528 | 1220 | 1239 | AGCCCCCAGGTGTCGGAGGA | 13 | 39267 | 39286 | 872 |
| 472529 | 1221 | 1240 | CAGCCCCCAGGTGTCGGAGG | 32 | 39268 | 39287 | 873 |
| 472530 | 1223 | 1242 | ACCAGCCCCCAGGTGTCGGA | 40 | 39270 | 39289 | 874 |
| 472531 | 1251 | 1270 | AACAGTGGTGATGGGCTTGG | 17 | 39298 | 39317 | 875 |
| 472532 | 1252 | 1271 | CAACAGTGGTGATGGGCTTG | 28 | 39299 | 39318 | 876 |
| 472533 | 1323 | 1342 | CATGGTGTGGTACAGGTCGA | 42 | 41294 | 41313 | 877 |
| 472534 | 1324 | 1343 | ACATGGTGTGGTACAGGTCG | 63 | 41295 | 41314 | 878 |
| 411878 | 1325 | 1344 | TACATGGTGTGGTACAGGTC | 63 | 41296 | 41315 | 879 |
| 472535 | 1326 | 1345 | GTACATGGTGTGGTACAGGT | 70 | 41297 | 41316 | 880 |
| 472536 | 1328 | 1347 | ATGTACATGGTGTGGTACAG | 56 | 41299 | 41318 | 881 |
| 472537 | 1329 | 1348 | CATGTACATGGTGTGGTACA | 50 | 41300 | 41319 | 882 |
| 472538 | 1331 | 1350 | TCCATGTACATGGTGTGGTA | 53 | 41302 | 41321 | 883 |
| 472539 | 1332 | 1351 | CTCCATGTACATGGTGTGGT | 68 | 41303 | 41322 | 884 |
| 472540 | 1333 | 1352 | CCTCCATGTACATGGTGTGG | 63 | 41304 | 41323 | 885 |
| 472541 | 1335 | 1354 | GGCCTCCATGTACATGGTGT | 48 | 41306 | 41325 | 886 |
| 472542 | 1336 | 1355 | GGGCCTCCATGTACATGGTG | 51 | 41307 | 41326 | 887 |
| 472543 | 1337 | 1356 | AGGGCCTCCATGTACATGGT | 56 | 41308 | 41327 | 888 |
| 369255 | 1339 | 1358 | CCAGGGCCTCCATGTACATG | 35 | 41310 | 41329 | 103 |
| 411944 | 1340 | 1359 | ACCAGGGCCTCCATGTACAT | 47 | 41311 | 41330 | 120 |
| 411947 | 1344 | 1363 | CTTCACCAGGGCCTCCATGT | 22 | 41315 | 41334 | 123 |
| 411948 | 1345 | 1364 | GCTTCACCAGGGCCTCCATG | 43 | 41316 | 41335 | 124 |
| 411950 | 1347 | 1366 | GAGCTTCACCAGGGCCTCCA | 47 | 41318 | 41337 | 126 |
| 411951 | 1349 | 1368 | AAGAGCTTCACCAGGGCCTC | 51 | 41320 | 41339 | 127 |
| 472544 | 1352 | 1371 | TCGAAGAGCTTCACCAGGGC | 60 | 41323 | 41342 | 889 |
| 472545 | 1353 | 1372 | GTCGAAGAGCTTCACCAGGG | 73 | 41324 | 41343 | 890 |
| 472546 | 1355 | 1374 | TTGTCGAAGAGCTTCACCAG | 45 | 41326 | 41345 | 891 |
| 472547 | 1356 | 1375 | CTTGTCGAAGAGCTTCACCA | 65 | 41327 | 41346 | 892 |
| 472548 | 1357 | 1376 | GCTTGTCGAAGAGCTTCACC | 86 | 41328 | 41347 | 893 |
| 472549 | 1358 | 1377 | TGCTTGTCGAAGAGCTTCAC | 68 | 41329 | 41348 | 894 |
| 472550 | 1360 | 1379 | TGTGCTTGTCGAAGAGCTTC | 70 | 41331 | 41350 | 895 |
| 472551 | 1361 | 1380 | TTGTGCTTGTCGAAGAGCTT | 40 | 41332 | 41351 | 896 |
| 472552 | 1362 | 1381 | CTTGTGCTTGTCGAAGAGCT | 77 | 41333 | 41352 | 897 |
| 366746 | 1366 | 1385 | TGGTCTTGTGCTTGTCGAAG | 37 | 41337 | 41356 | 151 |
| 472553 | 1368 | 1387 | CTTGGTCTTGTGCTTGTCGA | 58 | 41339 | 41358 | 898 |
| 472554 | 1369 | 1388 | ACTTGGTCTTGTGCTTGTCG | 60 | 41340 | 41359 | 899 |

TABLE 15-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472555 | 1370 | 1389 | AACTTGGTCTTGTGCTTGTC | 61 | 41341 | 41360 | 900 |
| 472556 | 1372 | 1391 | CGAACTTGGTCTTGTGCTTG | 55 | 41343 | 41362 | 901 |
| 472557 | 1373 | 1392 | CCGAACTTGGTCTTGTGCTT | 63 | 41344 | 41363 | 902 |
| 472558 | 1374 | 1393 | GCCGAACTTGGTCTTGTGCT | 59 | 41345 | 41364 | 903 |
| 472559 | 1375 | 1394 | GGCCGAACTTGGTCTTGTGC | 60 | 41346 | 41365 | 904 |
| 472560 | 1377 | 1396 | GAGGCCGAACTTGGTCTTGT | 53 | 41348 | 41367 | 905 |
| 472561 | 1378 | 1397 | GGAGGCCGAACTTGGTCTTG | 35 | 41349 | 41368 | 906 |
| 472562 | 1400 | 1419 | ACCTCCAGGACCTCAGTCTC | 66 | 41371 | 41390 | 907 |
| 472563 | 1401 | 1420 | CACCTCCAGGACCTCAGTCT | 19 | 41372 | 41391 | 908 |
| 472564 | 1402 | 1421 | TCACCTCCAGGACCTCAGTC | 40 | 41373 | 41392 | 909 |
| 472565 | 1404 | 1423 | GTTCACCTCCAGGACCTCAG | 60 | 41375 | 41394 | 910 |
| 472566 | 1405 | 1424 | AGTTCACCTCCAGGACCTCA | 23 | 41376 | 41395 | 911 |
| 472567 | 1406 | 1425 | CAGTTCACCTCCAGGACCTC | 13 | 41377 | 41396 | 912 |
| 472568 | 1408 | 1427 | CTCAGTTCACCTCCAGGACC | 67 | 41379 | 41398 | 913 |
| 472569 | 1409 | 1428 | GCTCAGTTCACCTCCAGGAC | 71 | 41380 | 41399 | 914 |
| 472570 | 1410 | 1429 | GGCTCAGTTCACCTCCAGGA | 84 | 41381 | 41400 | 915 |
| 472571 | 1411 | 1430 | TGGCTCAGTTCACCTCCAGG | 74 | 41382 | 41401 | 916 |
| 411955 | 1502 | 1521 | AAATAACCCACAGACACCCA | 81 | 41473 | 41492 | 131 |
| 411958 | 1506 | 1525 | TTTTAAATAACCCACAGACA | 68 | 41477 | 41496 | 134 |
| 472572 | 1538 | 1557 | TTGTAATGGTTTAGCAAAAT | 7 | 41509 | 41528 | 917 |
| 472573 | 1539 | 1558 | ATTGTAATGGTTTAGCAAAA | 47 | 41510 | 41529 | 918 |
| 472574 | 1540 | 1559 | CATTGTAATGGTTTAGCAAA | 18 | 41511 | 41530 | 919 |
| 472575 | 1541 | 1560 | ACATTGTAATGGTTTAGCAA | 40 | 41512 | 41531 | 920 |
| 472576 | 1543 | 1562 | TAACATTGTAATGGTTTAGC | 58 | 41514 | 41533 | 921 |
| 472577 | 1544 | 1563 | CTAACATTGTAATGGTTTAG | 49 | 41515 | 41534 | 922 |
| 472578 | 1545 | 1564 | CCTAACATTGTAATGGTTTA | 67 | 41516 | 41535 | 923 |
| 472579 | 1546 | 1565 | ACCTAACATTGTAATGGTTT | 27 | 41517 | 41536 | 924 |
| 472580 | 1548 | 1567 | AGACCTAACATTGTAATGGT | 54 | 41519 | 41538 | 925 |
| 472581 | 1549 | 1568 | AAGACCTAACATTGTAATGG | 46 | 41520 | 41539 | 926 |
| 472582 | 1550 | 1569 | AAAGACCTAACATTGTAATG | 34 | 41521 | 41540 | 927 |
| 472583 | 1551 | 1570 | AAAAGACCTAACATTGTAAT | 33 | 41522 | 41541 | 928 |
| 472584 | 1553 | 1572 | AAAAAAGACCTAACATTGTA | 53 | 41524 | 41543 | 929 |
| 472585 | 1554 | 1573 | TAAAAAAGACCTAACATTGT | 58 | 41525 | 41544 | 930 |
| 472586 | 1556 | 1575 | CTTAAAAAAGACCTAACATT | 25 | 41527 | 41546 | 931 |
| 472587 | 1557 | 1576 | TCTTAAAAAAGACCTAACAT | 23 | 41528 | 41547 | 932 |

Example 4: Antisense Inhibition of Human DGAT2 in HepG2 Cells by MOE Gapmers

Antisense oligonucleotides were designed targeting a DGAT2 nucleic acid and were tested for their effects on DGAT2 mRNA in vitro. The antisense oligonucleotides were tested in a series of experiments that had similar culture conditions. ISIS 413433, which consistently demonstrated higher potency than any of the previously disclosed oligonucleotides in the studies above was included in this study as a benchmark oligonucleotide. Antisense oligonucleotides that demonstrated about the same or greater potency than ISIS 413433 were therefore considered for further experimentation.

The results for each experiment are presented in separate tables shown below. Cultured HepG2 cells at a density of 20,000 cells per well were transfected using electroporation with 4,500 nM antisense oligonucleotide. After a treatment period of approximately 24 hours, RNA was isolated from the cells and DGAT2 mRNA levels were measured by quantitative real-time PCR. Human primer probe set RTS2988_MGB was used to measure mRNA levels. The potency of some oligonucleotides was measured with human primer probe set RTS2367 (forward sequence GGCCTCCCGGAGACTGA, designated herein as SEQ ID NO: 4; reverse sequence AAGTGATTGCAGCTGGTTCCT, designated herein as SEQ ID NO: 5; probe sequence AGGTGAACTGAGCCAGCCTTCGGG, designated herein as SEQ ID NO: 6). DGAT2 mRNA levels were adjusted according to total RNA content, as measured by RIBOGREEN®. Results are presented as percent inhibition of DGAT2, relative to untreated control cells. The results show several antisense oligonucleotides demonstrate greater potency than the benchmark oligonucleotides.

The newly designed chimeric antisense oligonucleotides in the Tables below were designed as 5-10-5 MOE gapmers or 3-10-4 MOE gapmers. The 5-10-5 MOE gapmers are 20 nucleosides in length, wherein the central gap segment comprises of ten 2'-deoxynucleosides and is flanked by wing segments on the 5' direction and the 3' direction comprising five nucleosides each. The 3-10-4 MOE gapmers are 17 nucleosides in length, wherein the central gap segment comprises of ten 2'-deoxynucleosides and is flanked by wing segments on the 5' direction and the 3' direction comprising three and four nucleosides respectively. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to SEQ ID NO: 1, SEQ ID NO: 2, or both. 'n/a' indicates that the antisense oligonucleotide does not target that particular gene sequence with 100% complementarity. In case the sequence alignment for a target gene in a particular table is not shown, it is understood that none of the oligonucleotides presented in that table align with 100% complementarity with that target gene.

TABLE 16

Inhibition of DGAT2 mRNA by 5-10-5 MOE gapmers targeting SEQ ID NO: 2

| ISIS NO | SEQ ID NO: 1 Start Site | SEQ ID NO: 1 Stop Site | Sequence | SEQ ID NO: 2 Start Site | SEQ ID NO: 2 Stop Site | % inhibition | SEQ ID NO |
|---|---|---|---|---|---|---|---|
| 483799 | 221 | 240 | ACGGCCCCGCGGGAAGCCGC | 9842 | 9861 | 8 | 569 |
| 483800 | 226 | 245 | CAGTCACGGCCCCGCGGGAA | 9847 | 9866 | 46 | 570 |
| 483801 | 231 | 250 | CCGCCCAGTCACGGCCCCGC | 9852 | 9871 | 0 | 571 |
| 483802 | 236 | 255 | GAAGCCCGCCCAGTCACGGC | 9857 | 9876 | 50 | 572 |
| 413433 | n/a | n/a | GCCTGGACAAGTCCTGCCCA | 32431 | 32450 | 85 | 425 |
| 483803 | n/a | n/a | ACCCCATCTCCCAGACCCCT | 9984 | 10003 | 75 | 496 |
| 483804 | n/a | n/a | CACTCACCCCATCTCCCAGA | 9989 | 10008 | 46 | 497 |
| 483805 | n/a | n/a | CAGGTCCATAACCCCTGCGC | 10014 | 10033 | 51 | 498 |
| 483806 | n/a | n/a | TCTCGCAGGTCCATAACCCC | 10019 | 10038 | 6 | 499 |
| 483807 | n/a | n/a | AATCTTCTCGCAGGTCCATA | 10024 | 10043 | 50 | 500 |
| 483808 | n/a | n/a | CAGAAAATCTTCTCGCAGGT | 10029 | 10048 | 49 | 501 |
| 483809 | n/a | n/a | CTTTCCAGAAAATCTTCTCG | 10034 | 10053 | 37 | 502 |
| 483810 | n/a | n/a | GGGCCCTTTCCAGAAAATCT | 10039 | 10058 | 40 | 503 |
| 483811 | n/a | n/a | CCACAGGGCCCTTTCCAGAA | 10044 | 10063 | 85 | 504 |
| 483812 | n/a | n/a | GCCTGCCACAGGGCCCTTTC | 10049 | 10068 | 76 | 505 |
| 483813 | n/a | n/a | CACCAGCCTGCCACAGGGCC | 10054 | 10073 | 80 | 506 |

TABLE 16-continued

Inhibition of DGAT2 mRNA by 5-10-5 MOE gapmers targeting SEQ ID NO: 2

| ISIS NO | SEQ ID NO: 1 Start Site | SEQ ID NO: 1 Stop Site | Sequence | SEQ ID NO: 2 Start Site | SEQ ID NO: 2 Stop Site | % inhibition | SEQ ID NO |
|---|---|---|---|---|---|---|---|
| 483814 | n/a | n/a | CACGGATGAGGGAAACAAGC | 10160 | 10179 | 73 | 507 |
| 483815 | n/a | n/a | AATATCCCTAATAACTAAGA | 10205 | 10224 | 35 | 508 |
| 483816 | n/a | n/a | TCTCGAATATCCCTAATAAC | 10210 | 10229 | 84 | 509 |
| 483817 | n/a | n/a | GGAGTTCTCGAATATCCCTA | 10215 | 10234 | 96 | 510 |
| 483818 | n/a | n/a | AAACCCATACCATCCTGCCC | 10327 | 10346 | 76 | 511 |
| 483819 | n/a | n/a | TGGTGGCTGTCTCAGGAGAC | 10351 | 10370 | 49 | 512 |
| 483820 | n/a | n/a | CCGTCTGGTGGCTGTCTCAG | 10356 | 10375 | 36 | 513 |
| 483821 | n/a | n/a | GGCAGACACACCTGTTCCAG | 10389 | 10408 | 64 | 514 |
| 483822 | n/a | n/a | GACAGGGCAGACACACCTGT | 10394 | 10413 | 64 | 515 |
| 483823 | n/a | n/a | CAGAGGACAGGGCAGACACA | 10399 | 10418 | 69 | 516 |
| 483824 | n/a | n/a | CCAGAGCCTGGGCGAGAGGA | 10430 | 10449 | 45 | 517 |
| 483825 | n/a | n/a | CAGGGTCCTCTCCGCTGCCT | 10490 | 10509 | 91 | 518 |
| 483826 | n/a | n/a | CTGAGGACCTCAGTTCTACC | 10522 | 10541 | 83 | 519 |
| 483827 | n/a | n/a | ATTCACTGAGGACCTCAGTT | 10527 | 10546 | 67 | 520 |
| 483828 | n/a | n/a | GCGCGATTCACTGAGGACCT | 10532 | 10551 | 88 | 521 |
| 483829 | n/a | n/a | ACTCTGCGCGATTCACTGAG | 10537 | 10556 | 73 | 522 |
| 483830 | n/a | n/a | CTCCCACTTCAGTTTCTCCA | 10645 | 10664 | 83 | 523 |
| 483831 | n/a | n/a | GCTTCCTCCCACTTCAGTTT | 10650 | 10669 | 86 | 524 |
| 483832 | n/a | n/a | GGCATGCTTCCTCCCACTTC | 10655 | 10674 | 89 | 525 |
| 483833 | n/a | n/a | ACTTAGGCATGCTTCCTCCC | 10660 | 10679 | 89 | 526 |
| 483834 | n/a | n/a | GGAAAACTTAGGCATGCTTC | 10665 | 10684 | 92 | 527 |
| 483835 | n/a | n/a | GCTAAGGAAAACTTAGGCAT | 10670 | 10689 | 85 | 528 |
| 483836 | n/a | n/a | CATCAGCTAAGGAAAACTTA | 10675 | 10694 | 53 | 529 |
| 483837 | n/a | n/a | CAAGGCATCAGCTAAGGAAA | 10680 | 10699 | 27 | 530 |
| 483838 | n/a | n/a | ATTTGTACTTGAATCCAGGG | 10702 | 10721 | 77 | 531 |
| 483839 | n/a | n/a | GTGATGACTTCCCAGGGTCT | 10727 | 10746 | 87 | 532 |
| 483840 | n/a | n/a | CAGCTGTGATGACTTCCCAG | 10732 | 10751 | 84 | 533 |
| 483841 | n/a | n/a | CAGGACAGCTGTGATGACTT | 10737 | 10756 | 80 | 534 |
| 483842 | n/a | n/a | CAGACCAGGACAGCTGTGAT | 10742 | 10761 | 72 | 535 |
| 483843 | n/a | n/a | CACACGCAGACCAGGACAGC | 10748 | 10767 | 54 | 536 |
| 483844 | n/a | n/a | AGACACACACGCAGACCAGG | 10753 | 10772 | 44 | 537 |
| 483845 | n/a | n/a | ATGCAAGACACACACGCAGA | 10758 | 10777 | 45 | 538 |
| 483846 | n/a | n/a | GCTTCATGCAAGACACACAC | 10763 | 10782 | 78 | 539 |
| 483847 | n/a | n/a | ATGTCAGAGAGGCTCAGCAA | 10814 | 10833 | 67 | 540 |
| 483848 | n/a | n/a | AATCCATGTCAGAGAGGCTC | 10819 | 10838 | 93 | 541 |

TABLE 16-continued

Inhibition of DGAT2 mRNA by 5-10-5 MOE gapmers targeting SEQ ID NO: 2

| ISIS NO | SEQ ID NO: 1 Start Site | SEQ ID NO: 1 Stop Site | Sequence | SEQ ID NO: 2 Start Site | SEQ ID NO: 2 Stop Site | % inhibition | SEQ ID NO |
|---|---|---|---|---|---|---|---|
| 483849 | n/a | n/a | AGAAAAATCCATGTCAGAGA | 10824 | 10843 | 37 | 542 |
| 483850 | n/a | n/a | ACTAAAGAAAAATCCATGTC | 10829 | 10848 | 49 | 543 |
| 483851 | n/a | n/a | TAGTTACTAAAGAAAAATCC | 10834 | 10853 | 21 | 544 |
| 483852 | n/a | n/a | GGATAGTCGATTTACCAGAA | 10940 | 10959 | 88 | 545 |
| 483853 | n/a | n/a | TCTTTGGATAGTCGATTTAC | 10945 | 10964 | 66 | 546 |
| 483854 | n/a | n/a | ACTAAAATGCTAATAGGAAG | 10968 | 10987 | 2 | 547 |
| 483855 | n/a | n/a | GATATACTAAAATGCTAATA | 10973 | 10992 | 9 | 548 |
| 483856 | n/a | n/a | CAAGAGATATACTAAAATGC | 10978 | 10997 | 32 | 549 |
| 483857 | n/a | n/a | ATGATCAAGAGATATACTAA | 10983 | 11002 | 36 | 550 |
| 483858 | n/a | n/a | AGAAAATGATCAAGAGATAT | 10988 | 11007 | 6 | 551 |
| 483859 | n/a | n/a | TATAAAGAAAATGATCAAGA | 10993 | 11012 | 6 | 552 |
| 483860 | n/a | n/a | ATGTGTATAAAGAAAATGAT | 10998 | 11017 | 0 | 553 |
| 483861 | n/a | n/a | ATGCAATGTGTATAAAGAAA | 11003 | 11022 | 36 | 554 |
| 483862 | n/a | n/a | TATCTATGCAATGTGTATAA | 11008 | 11027 | 75 | 555 |
| 483863 | n/a | n/a | ATTCATAACTATATCTACAG | 11042 | 11061 | 52 | 556 |
| 483864 | n/a | n/a | ACAAGATTCATAACTATATC | 11047 | 11066 | 31 | 557 |
| 483865 | n/a | n/a | AGAAAACAAGATTCATAACT | 11052 | 11071 | 33 | 558 |
| 483866 | n/a | n/a | CCTCGATGTTACATTAAGGG | 11074 | 11093 | 90 | 559 |
| 483867 | n/a | n/a | GGAAACCTCGATGTTACATT | 11079 | 11098 | 59 | 560 |
| 483868 | n/a | n/a | ATTGCAACCACTAGGACATT | 11123 | 11142 | 60 | 561 |
| 483869 | n/a | n/a | GGGTTATTGCAACCACTAGG | 11128 | 11147 | 91 | 562 |
| 483870 | n/a | n/a | CACAGTTAAAGTGTGGTACA | 11158 | 11177 | 86 | 563 |
| 483871 | n/a | n/a | TAGGTCACAGTTAAAGTGTG | 11163 | 11182 | 60 | 564 |
| 483872 | n/a | n/a | ATGCCTAGGTCACAGTTAAA | 11168 | 11187 | 74 | 565 |
| 483873 | n/a | n/a | TGCCAATGCCTAGGTCACAG | 11173 | 11192 | 90 | 566 |
| 483874 | n/a | n/a | AGCAATGCCAATGCCTAGGT | 11178 | 11197 | 91 | 567 |
| 483875 | n/a | n/a | CACAGCGATAATCACACAAG | 11199 | 11218 | 87 | 568 |

TABLE 17

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 89 | 32431 | 32450 | 425 |
| 472665 | 1870 | 1889 | CTCCAACTCCTCCCCTTGGC | 56 | 41841 | 41860 | 933 |

TABLE 17-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472666 | 1871 | 1890 | TCTCCAACTCCTCCCCTTGG | 37 | 41842 | 41861 | 934 |
| 472667 | 1873 | 1892 | GCTCTCCAACTCCTCCCCTT | 63 | 41844 | 41863 | 935 |
| 472668 | 1874 | 1893 | TGCTCTCCAACTCCTCCCCT | 65 | 41845 | 41864 | 936 |
| 472669 | 1917 | 1936 | CATTCCAGATGCCTACTACT | 63 | 41888 | 41907 | 937 |
| 472670 | 1918 | 1937 | GCATTCCAGATGCCTACTAC | 68 | 41889 | 41908 | 938 |
| 472671 | 1919 | 1938 | AGCATTCCAGATGCCTACTA | 81 | 41890 | 41909 | 939 |
| 472672 | 1920 | 1939 | GAGCATTCCAGATGCCTACT | 77 | 41891 | 41910 | 940 |
| 472673 | 1993 | 2012 | CCTGGAGGCCAGTCCAGGCT | 33 | 41964 | 41983 | 941 |
| 472674 | 1994 | 2013 | TCCTGGAGGCCAGTCCAGGC | 22 | 41965 | 41984 | 942 |
| 472675 | 1996 | 2015 | CATCCTGGAGGCCAGTCCAG | 14 | 41967 | 41986 | 943 |
| 472676 | 1997 | 2016 | TCATCCTGGAGGCCAGTCCA | 47 | 41968 | 41987 | 944 |
| 472677 | 1999 | 2018 | CCTCATCCTGGAGGCCAGTC | 57 | 41970 | 41989 | 945 |
| 472678 | 2000 | 2019 | TCCTCATCCTGGAGGCCAGT | 37 | 41971 | 41990 | 946 |
| 472679 | 2001 | 2020 | ATCCTCATCCTGGAGGCCAG | 50 | 41972 | 41991 | 947 |
| 472680 | 2002 | 2021 | CATCCTCATCCTGGAGGCCA | 56 | 41973 | 41992 | 948 |
| 472681 | 2004 | 2023 | CCCATCCTCATCCTGGAGGC | 29 | 41975 | 41994 | 949 |
| 472682 | 2005 | 2024 | CCCCATCCTCATCCTGGAGG | 21 | 41976 | 41995 | 950 |
| 472683 | 2007 | 2026 | ACCCCCATCCTCATCCTGGA | 24 | 41978 | 41997 | 951 |
| 472684 | 2008 | 2027 | CACCCCCATCCTCATCCTGG | 8 | 41979 | 41998 | 952 |
| 472685 | 2009 | 2028 | CCACCCCCATCCTCATCCTG | 39 | 41980 | 41999 | 953 |
| 472686 | 2011 | 2030 | TGCCACCCCCATCCTCATCC | 46 | 41982 | 42001 | 954 |
| 472687 | 2012 | 2031 | TTGCCACCCCCATCCTCATC | 48 | 41983 | 42002 | 955 |
| 472688 | 2013 | 2032 | ATTGCCACCCCCATCCTCAT | 57 | 41984 | 42003 | 956 |
| 472689 | 2015 | 2034 | TCATTGCCACCCCCATCCTC | 43 | 41986 | 42005 | 957 |
| 472690 | 2016 | 2035 | GTCATTGCCACCCCCATCCT | 29 | 41987 | 42006 | 958 |
| 472691 | 2017 | 2036 | TGTCATTGCCACCCCCATCC | 51 | 41988 | 42007 | 959 |
| 472692 | 2019 | 2038 | GGTGTCATTGCCACCCCCAT | 74 | 41990 | 42009 | 960 |
| 472693 | 2079 | 2098 | GCTCATGGTGGCGGCATCCT | 77 | 42050 | 42069 | 961 |
| 472694 | 2080 | 2099 | AGCTCATGGTGGCGGCATCC | 66 | 42051 | 42070 | 962 |
| 472695 | 2082 | 2101 | CTAGCTCATGGTGGCGGCAT | 65 | 42053 | 42072 | 963 |
| 472696 | 2083 | 2102 | CCTAGCTCATGGTGGCGGCA | 68 | 42054 | 42073 | 964 |
| 472697 | 2085 | 2104 | CACCTAGCTCATGGTGGCGG | 49 | 42056 | 42075 | 965 |
| 472698 | 2086 | 2105 | CCACCTAGCTCATGGTGGCG | 44 | 42057 | 42076 | 966 |
| 472699 | 2088 | 2107 | CTCCACCTAGCTCATGGTGG | 18 | 42059 | 42078 | 967 |
| 472700 | 2089 | 2108 | ACTCCACCTAGCTCATGGTG | 61 | 42060 | 42079 | 968 |

TABLE 17-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472701 | 2090 | 2109 | TACTCCACCTAGCTCATGGT | 46 | 42061 | 42080 | 969 |
| 472702 | 2092 | 2111 | GTTACTCCACCTAGCTCATG | 51 | 42063 | 42082 | 970 |
| 472703 | 2093 | 2112 | AGTTACTCCACCTAGCTCAT | 58 | 42064 | 42083 | 971 |
| 472704 | 2094 | 2113 | CAGTTACTCCACCTAGCTCA | 66 | 42065 | 42084 | 972 |
| 472705 | 2095 | 2114 | CCAGTTACTCCACCTAGCTC | 80 | 42066 | 42085 | 973 |
| 472706 | 2097 | 2116 | AACCAGTTACTCCACCTAGC | 71 | 42068 | 42087 | 974 |
| 472707 | 2098 | 2117 | AAACCAGTTACTCCACCTAG | 68 | 42069 | 42088 | 975 |
| 472708 | 2100 | 2119 | AAAAACCAGTTACTCCACCT | 67 | 42071 | 42090 | 976 |
| 472709 | 2101 | 2120 | GAAAAACCAGTTACTCCACC | 68 | 42072 | 42091 | 977 |
| 472710 | 2103 | 2122 | AAGAAAAACCAGTTACTCCA | 53 | 42074 | 42093 | 978 |
| 472711 | 2104 | 2123 | CAAGAAAAACCAGTTACTCC | 61 | 42075 | 42094 | 979 |
| 472712 | 2106 | 2125 | CCCAAGAAAAACCAGTTACT | 67 | 42077 | 42096 | 980 |
| 472713 | 2107 | 2126 | ACCCAAGAAAAACCAGTTAC | 71 | 42078 | 42097 | 981 |
| 472714 | 2108 | 2127 | CACCCAAGAAAAACCAGTTA | 56 | 42079 | 42098 | 982 |
| 472715 | 2109 | 2128 | CCACCCAAGAAAAACCAGTT | 61 | 42080 | 42099 | 983 |
| 472716 | 2111 | 2130 | AGCCACCCAAGAAAAACCAG | 62 | 42082 | 42101 | 984 |
| 472717 | 2112 | 2131 | CAGCCACCCAAGAAAAACCA | 69 | 42083 | 42102 | 985 |
| 472718 | 2114 | 2133 | ATCAGCCACCCAAGAAAAAC | 58 | 42085 | 42104 | 986 |
| 472719 | 2115 | 2134 | CATCAGCCACCCAAGAAAAA | 46 | 42086 | 42105 | 987 |
| 472720 | 2116 | 2135 | TCATCAGCCACCCAAGAAAA | 64 | 42087 | 42106 | 988 |
| 472721 | 2118 | 2137 | TGTCATCAGCCACCCAAGAA | 48 | 42089 | 42108 | 989 |
| 472722 | 2119 | 2138 | ATGTCATCAGCCACCCAAGA | 50 | 42090 | 42109 | 990 |
| 472723 | 2121 | 2140 | CCATGTCATCAGCCACCCAA | 79 | 42092 | 42111 | 991 |
| 472724 | 2122 | 2141 | TCCATGTCATCAGCCACCCA | 79 | 42093 | 42112 | 992 |
| 472725 | 2123 | 2142 | ATCCATGTCATCAGCCACCC | 83 | 42094 | 42113 | 993 |
| 472726 | 2124 | 2143 | CATCCATGTCATCAGCCACC | 80 | 42095 | 42114 | 994 |
| 472727 | 2126 | 2145 | TGCATCCATGTCATCAGCCA | 81 | 42097 | 42116 | 995 |
| 472728 | 2127 | 2146 | CTGCATCCATGTCATCAGCC | 78 | 42098 | 42117 | 996 |
| 413319 | 2128 | 2147 | GCTGCATCCATGTCATCAGC | 74 | 42099 | 42118 | 154 |
| 472729 | 2129 | 2148 | TGCTGCATCCATGTCATCAG | 80 | 42100 | 42119 | 997 |
| 472730 | 2130 | 2149 | GTGCTGCATCCATGTCATCA | 68 | 42101 | 42120 | 998 |
| 472731 | 2132 | 2151 | CTGTGCTGCATCCATGTCAT | 64 | 42103 | 42122 | 999 |
| 472732 | 2133 | 2152 | TCTGTGCTGCATCCATGTCA | 80 | 42104 | 42123 | 1000 |
| 472733 | 2134 | 2153 | GTCTGTGCTGCATCCATGTC | 83 | 42105 | 42124 | 1001 |
| 472734 | 2135 | 2154 | AGTCTGTGCTGCATCCATGT | 68 | 42106 | 42125 | 1002 |
| 472735 | 2137 | 2156 | TGAGTCTGTGCTGCATCCAT | 71 | 42108 | 42127 | 1003 |

TABLE 17-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472736 | 2138 | 2157 | CTGAGTCTGTGCTGCATCCA | 78 | 42109 | 42128 | 1004 |
| 472737 | 2139 | 2158 | GCTGAGTCTGTGCTGCATCC | 80 | 42110 | 42129 | 1005 |
| 472738 | 2140 | 2159 | GGCTGAGTCTGTGCTGCATC | 84 | 42111 | 42130 | 1006 |
| 472739 | 2141 | 2160 | AGGCTGAGTCTGTGCTGCAT | 76 | 42112 | 42131 | 1007 |
| 472740 | 2142 | 2161 | AAGGCTGAGTCTGTGCTGCA | 81 | 42113 | 42132 | 1008 |

TABLE 18

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 413433 | n/a | n/a | GCCTGGACAAGTCCTGCCCA | 89 | 32431 | 32450 | 425 |
| 411901 | 695 | 714 | GTCAGCAGGTTGTGTGTCTT | 64 | 37223 | 37242 | 64 |
| 472741 | 2144 | 2163 | CCAAGGCTGAGTCTGTGCTG | 60 | 42115 | 42134 | 1009 |
| 472742 | 2145 | 2164 | GCCAAGGCTGAGTCTGTGCT | 63 | 42116 | 42135 | 1010 |
| 472743 | 2147 | 2166 | AGGCCAAGGCTGAGTCTGTG | 55 | 42118 | 42137 | 1011 |
| 472744 | 2148 | 2167 | CAGGCCAAGGCTGAGTCTGT | 39 | 42119 | 42138 | 1012 |
| 472745 | 2150 | 2169 | TCCAGGCCAAGGCTGAGTCT | 56 | 42121 | 42140 | 1013 |
| 472746 | 2151 | 2170 | CTCCAGGCCAAGGCTGAGTC | 62 | 42122 | 42141 | 1014 |
| 472747 | 2152 | 2171 | GCTCCAGGCCAAGGCTGAGT | 77 | 42123 | 42142 | 1015 |
| 472748 | 2153 | 2172 | TGCTCCAGGCCAAGGCTGAG | 43 | 42124 | 42143 | 1016 |
| 472749 | 2155 | 2174 | TGTGCTCCAGGCCAAGGCTG | 63 | 42126 | 42145 | 1017 |
| 472750 | 2156 | 2175 | ATGTGCTCCAGGCCAAGGCT | 69 | 42127 | 42146 | 1018 |
| 472751 | 2181 | 2200 | AGGTAAACTGAGGCCACCAG | 35 | 42152 | 42171 | 1019 |
| 472752 | 2183 | 2202 | GAAGGTAAACTGAGGCCACC | 72 | 42154 | 42173 | 1020 |
| 472753 | 2184 | 2203 | GGAAGGTAAACTGAGGCCAC | 45 | 42155 | 42174 | 1021 |
| 472754 | 2214 | 2233 | TCTTCCTCACATCCAGAATC | 49 | 42185 | 42204 | 1022 |
| 472755 | 2215 | 2234 | CTCTTCCTCACATCCAGAAT | 62 | 42186 | 42205 | 1023 |
| 472756 | 2237 | 2256 | CAGGCCCCTTCTGAAGAGGG | 73 | 42208 | 42227 | 1024 |
| 472757 | 2238 | 2257 | CCAGGCCCCTTCTGAAGAGG | 68 | 42209 | 42228 | 1025 |
| 472758 | 2240 | 2259 | GGCCAGGCCCCTTCTGAAGA | 41 | 42211 | 42230 | 1026 |
| 472759 | 2241 | 2260 | AGGCCAGGCCCCTTCTGAAG | 51 | 42212 | 42231 | 1027 |
| 472760 | 2243 | 2262 | GAAGGCCAGGCCCCTTCTGA | 32 | 42214 | 42233 | 1028 |
| 472761 | 2244 | 2263 | AGAAGGCCAGGCCCCTTCTG | 28 | 42215 | 42234 | 1029 |

TABLE 18-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472762 | 2245 | 2264 | CAGAAGGCCAGGCCCCTTCT | 24 | 42216 | 42235 | 1030 |
| 472763 | 2247 | 2266 | CTCAGAAGGCCAGGCCCCTT | 54 | 42218 | 42237 | 1031 |
| 472764 | 2248 | 2267 | GCTCAGAAGGCCAGGCCCCT | 72 | 42219 | 42238 | 1032 |
| 472765 | 2250 | 2269 | CTGCTCAGAAGGCCAGGCCC | 60 | 42221 | 42240 | 1033 |
| 472766 | 2251 | 2270 | GCTGCTCAGAAGGCCAGGCC | 81 | 42222 | 42241 | 1034 |
| 472767 | 2253 | 2272 | CTGCTGCTCAGAAGGCCAGG | 51 | 42224 | 42243 | 1035 |
| 472768 | 2254 | 2273 | TCTGCTGCTCAGAAGGCCAG | 79 | 42225 | 42244 | 1036 |
| 472769 | 2255 | 2274 | ATCTGCTGCTCAGAAGGCCA | 63 | 42226 | 42245 | 1037 |
| 472770 | 2256 | 2275 | AATCTGCTGCTCAGAAGGCC | 69 | 42227 | 42246 | 1038 |
| 472771 | 2258 | 2277 | CTAATCTGCTGCTCAGAAGG | 57 | 42229 | 42248 | 1039 |
| 472772 | 2259 | 2278 | ACTAATCTGCTGCTCAGAAG | 63 | 42230 | 42249 | 1040 |
| 472773 | 2260 | 2279 | AACTAATCTGCTGCTCAGAA | 52 | 42231 | 42250 | 1041 |
| 472774 | 2261 | 2280 | GAACTAATCTGCTGCTCAGA | 45 | 42232 | 42251 | 1042 |
| 472775 | 2262 | 2281 | GGAACTAATCTGCTGCTCAG | 70 | 42233 | 42252 | 1043 |
| 472776 | 2263 | 2282 | TGGAACTAATCTGCTGCTCA | 73 | 42234 | 42253 | 1044 |
| 472777 | 2264 | 2283 | TTGGAACTAATCTGCTGCTC | 70 | 42235 | 42254 | 1045 |
| 472778 | 2266 | 2285 | CTTTGGAACTAATCTGCTGC | 69 | 42237 | 42256 | 1046 |
| 472779 | 2267 | 2286 | GCTTTGGAACTAATCTGCTG | 70 | 42238 | 42257 | 1047 |
| 472780 | 2268 | 2287 | TGCTTTGGAACTAATCTGCT | 76 | 42239 | 42258 | 1048 |
| 472781 | 2269 | 2288 | CTGCTTTGGAACTAATCTGC | 71 | 42240 | 42259 | 1049 |
| 472782 | 2270 | 2289 | CCTGCTTTGGAACTAATCTG | 55 | 42241 | 42260 | 1050 |
| 472783 | 2272 | 2291 | CACCTGCTTTGGAACTAATC | 65 | 42243 | 42262 | 1051 |
| 472784 | 2273 | 2292 | CCACCTGCTTTGGAACTAAT | 78 | 42244 | 42263 | 1052 |
| 472785 | 2275 | 2294 | GGCCACCTGCTTTGGAACTA | 66 | 42246 | 42265 | 1053 |
| 472786 | 2276 | 2295 | GGGCCACCTGCTTTGGAACT | 67 | 42247 | 42266 | 1054 |
| 472787 | 2296 | 2315 | AAAGTGAGGCTTGGGTTCGG | 58 | 42267 | 42286 | 1055 |
| 472788 | 2297 | 2316 | AAAAGTGAGGCTTGGGTTCG | 54 | 42268 | 42287 | 1056 |
| 472789 | 2299 | 2318 | AGAAAAGTGAGGCTTGGGTT | 65 | 42270 | 42289 | 1057 |
| 472790 | 2300 | 2319 | CAGAAAAGTGAGGCTTGGGT | 61 | 42271 | 42290 | 1058 |
| 472791 | 2302 | 2321 | CACAGAAAAGTGAGGCTTGG | 70 | 42273 | 42292 | 1059 |
| 472792 | 2303 | 2322 | GCACAGAAAAGTGAGGCTTG | 81 | 42274 | 42293 | 1060 |
| 472793 | 2305 | 2324 | AGGCACAGAAAAGTGAGGCT | 82 | 42276 | 42295 | 1061 |
| 472794 | 2306 | 2325 | AAGGCACAGAAAAGTGAGGC | 58 | 42277 | 42296 | 1062 |
| 472795 | 2308 | 2327 | GGAAGGCACAGAAAAGTGAG | 29 | 42279 | 42298 | 1063 |
| 472796 | 2309 | 2328 | AGGAAGGCACAGAAAAGTGA | 24 | 42280 | 42299 | 1064 |
| 472797 | 2311 | 2330 | TCAGGAAGGCACAGAAAAGT | 67 | 42282 | 42301 | 1065 |

TABLE 18-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472798 | 2312 | 2331 | CTCAGGAAGGCACAGAAAAG | 32 | 42283 | 42302 | 1066 |
| 472799 | 2314 | 2333 | CCCTCAGGAAGGCACAGAAA | 48 | 42285 | 42304 | 1067 |
| 472800 | 2315 | 2334 | CCCCTCAGGAAGGCACAGAA | 55 | 42286 | 42305 | 1068 |
| 472801 | 2316 | 2335 | CCCCCTCAGGAAGGCACAGA | 57 | 42287 | 42306 | 1069 |
| 472802 | 2318 | 2337 | AACCCCCTCAGGAAGGCACA | 57 | 42289 | 42308 | 1070 |
| 472803 | 2319 | 2338 | CAACCCCCTCAGGAAGGCAC | 63 | 42290 | 42309 | 1071 |
| 472804 | 2320 | 2339 | CCAACCCCCTCAGGAAGGCA | 66 | 42291 | 42310 | 1072 |
| 472805 | 2321 | 2340 | CCCAACCCCCTCAGGAAGGC | 67 | 42292 | 42311 | 1073 |
| 472806 | 2322 | 2341 | GCCCAACCCCCTCAGGAAGG | 1 | 42293 | 42312 | 1074 |
| 472807 | 2372 | 2391 | CTCATCAAGAGATAACAGAA | 47 | 42343 | 42362 | 1075 |
| 472808 | 2374 | 2393 | ATCTCATCAAGAGATAACAG | 56 | 42345 | 42364 | 1076 |
| 472809 | 2375 | 2394 | GATCTCATCAAGAGATAACA | 48 | 42346 | 42365 | 1077 |
| 472810 | 2377 | 2396 | ATGATCTCATCAAGAGATAA | 69 | 42348 | 42367 | 1078 |
| 472811 | 2398 | 2417 | ACAAAAGTCTGACATGGTGC | 82 | 42369 | 42388 | 1079 |
| 472812 | 2400 | 2419 | ATACAAAAGTCTGACATGGT | 74 | 42371 | 42390 | 1080 |
| 472813 | 2401 | 2420 | TATACAAAAGTCTGACATGG | 52 | 42372 | 42391 | 1081 |
| 472814 | 2403 | 2422 | CATATACAAAAGTCTGACAT | 45 | 42374 | 42393 | 1082 |
| 472815 | 2404 | 2423 | GCATATACAAAAGTCTGACA | 78 | 42375 | 42394 | 1083 |
| 472816 | 2405 | 2424 | GGCATATACAAAAGTCTGAC | 81 | 42376 | 42395 | 1084 |

TABLE 19

Inhibition of DGAT2 mRNA by 3-10-4 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 496047 | 1000 | 1016 | CATTCTTGCCAGGCATG | 42 | 38153 | 38169 | 1102 |
| 496048 | 1003 | 1019 | CTGCATTCTTGCCAGGC | 61 | 38156 | 38172 | 1103 |
| 496049 | 1004 | 1020 | ACTGCATTCTTGCCAGG | 43 | 38157 | 38173 | 1104 |
| 496050 | 1005 | 1021 | GACTGCATTCTTGCCAG | 31 | 38158 | 38174 | 1105 |
| 496051 | 1015 | 1031 | TCCGCAGGGTGACTGCA | 59 | 38168 | 38184 | 1106 |
| 496052 | 1016 | 1032 | TTCCGCAGGGTGACTGC | 60 | 38169 | 38185 | 1107 |
| 496053 | 1017 | 1033 | GTTCCGCAGGGTGACTG | 64 | 38170 | 38186 | 1108 |
| 496054 | 1096 | 1112 | ACACTTCATTCTCTCCA | 39 | 39143 | 39159 | 1109 |
| 496055 | 1097 | 1113 | TACACTTCATTCTCTCC | 39 | 39144 | 39160 | 1110 |

TABLE 19-continued

Inhibition of DGAT2 mRNA by 3-10-4 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 496056 | 1098 | 1114 | GTACACTTCATTCTCTC | 44 | 39145 | 39161 | 1111 |
| 496057 | 1099 | 1115 | TGTACACTTCATTCTCT | 36 | 39146 | 39162 | 1112 |
| 496058 | 1100 | 1116 | TTGTACACTTCATTCTC | 28 | 39147 | 39163 | 1113 |
| 496059 | 1101 | 1117 | CTTGTACACTTCATTCT | 35 | 39148 | 39164 | 1114 |
| 496060 | 1102 | 1118 | GCTTGTACACTTCATTC | 48 | 39149 | 39165 | 1115 |
| 496061 | 1103 | 1119 | TGCTTGTACACTTCATT | 40 | 39150 | 39166 | 1116 |
| 496062 | 1104 | 1120 | CTGCTTGTACACTTCAT | 63 | 39151 | 39167 | 1117 |
| 496063 | 1105 | 1121 | CCTGCTTGTACACTTCA | 62 | 39152 | 39168 | 1118 |
| 496064 | 1106 | 1122 | ACCTGCTTGTACACTTC | 47 | 39153 | 39169 | 1119 |
| 496065 | 1107 | 1123 | CACCTGCTTGTACACTT | 39 | 39154 | 39170 | 1120 |
| 496066 | 1108 | 1124 | TCACCTGCTTGTACACT | 43 | 39155 | 39171 | 1121 |
| 496067 | 1109 | 1125 | ATCACCTGCTTGTACAC | 23 | 39156 | 39172 | 1122 |
| 496068 | 1119 | 1135 | CTCCTCGAAGATCACCT | 9 | 39166 | 39182 | 1123 |
| 496069 | 1120 | 1136 | CCTCCTCGAAGATCACC | 26 | 39167 | 39183 | 1124 |
| 496070 | 1121 | 1137 | CCCTCCTCGAAGATCAC | 25 | 39168 | 39184 | 1125 |
| 496071 | 1357 | 1373 | TGTCGAAGAGCTTCACC | 36 | 41328 | 41344 | 1126 |
| 496072 | 1358 | 1374 | TTGTCGAAGAGCTTCAC | 7 | 41329 | 41345 | 1127 |
| 496073 | 1359 | 1375 | CTTGTCGAAGAGCTTCA | 22 | 41330 | 41346 | 1128 |
| 496074 | 1362 | 1378 | GTGCTTGTCGAAGAGCT | 44 | 41333 | 41349 | 1129 |
| 496075 | 1363 | 1379 | TGTGCTTGTCGAAGAGC | 33 | 41334 | 41350 | 1130 |
| 496076 | 1364 | 1380 | TTGTGCTTGTCGAAGAG | 10 | 41335 | 41351 | 1131 |
| 496077 | 1410 | 1426 | TCAGTTCACCTCCAGGA | 11 | 41381 | 41397 | 1132 |
| 496078 | 1411 | 1427 | CTCAGTTCACCTCCAGG | 11 | 41382 | 41398 | 1133 |
| 496079 | 1412 | 1428 | GCTCAGTTCACCTCCAG | 25 | 41383 | 41399 | 1134 |
| 496080 | 1413 | 1429 | GGCTCAGTTCACCTCCA | 56 | 41384 | 41400 | 1135 |
| 496081 | 1502 | 1518 | TAACCCACAGACACCCA | 61 | 41473 | 41489 | 1136 |
| 496082 | 1503 | 1519 | ATAACCCACAGACACCC | 55 | 41474 | 41490 | 1137 |
| 496083 | 1504 | 1520 | AATAACCCACAGACACC | 59 | 41475 | 41491 | 1138 |
| 496084 | 1627 | 1643 | AGATTTAGCCACCACCT | 17 | 41598 | 41614 | 1139 |
| 496085 | 1628 | 1644 | CAGATTTAGCCACCACC | 58 | 41599 | 41615 | 1140 |
| 496086 | 1629 | 1645 | CCAGATTTAGCCACCAC | 60 | 41600 | 41616 | 1141 |
| 496087 | 1630 | 1646 | CCCAGATTTAGCCACCA | 62 | 41601 | 41617 | 1142 |
| 496088 | 1631 | 1647 | GCCCAGATTTAGCCACC | 28 | 41602 | 41618 | 1143 |
| 496089 | 1853 | 1869 | AGAGAAACTGGTCCTGC | 0 | 41824 | 41840 | 1144 |
| 496090 | 1854 | 1870 | CAGAGAAACTGGTCCTG | 0 | 41825 | 41841 | 1145 |
| 496091 | 1855 | 1871 | GCAGAGAAACTGGTCCT | 42 | 41826 | 41842 | 1146 |

TABLE 19-continued

Inhibition of DGAT2 mRNA by 3-10-4 MOE gapmers targeting SEQ ID NOs: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 496092 | 2123 | 2139 | CATGTCATCAGCCACCC | 52 | 42094 | 42110 | 1147 |
| 496093 | 2124 | 2140 | CCATGTCATCAGCCACC | 62 | 42095 | 42111 | 1148 |
| 496094 | 2125 | 2141 | TCCATGTCATCAGCCAC | 60 | 42096 | 42112 | 1149 |
| 496095 | 2134 | 2150 | TGTGCTGCATCCATGTC | 53 | 42105 | 42121 | 1150 |
| 496096 | 2135 | 2151 | CTGTGCTGCATCCATGT | 21 | 42106 | 42122 | 1151 |
| 496097 | 2136 | 2152 | TCTGTGCTGCATCCATG | 33 | 42107 | 42123 | 1152 |
| 496098 | 2140 | 2156 | TGAGTCTGTGCTGCATC | 60 | 42111 | 42127 | 1153 |
| 496099 | 2141 | 2157 | CTGAGTCTGTGCTGCAT | 58 | 42112 | 42128 | 1154 |
| 496100 | 2142 | 2158 | GCTGAGTCTGTGCTGCA | 72 | 42113 | 42129 | 1155 |
| 496101 | 2305 | 2321 | CACAGAAAAGTGAGGCT | 53 | 42276 | 42292 | 1156 |
| 496102 | 2306 | 2322 | GCACAGAAAAGTGAGGC | 49 | 42277 | 42293 | 1157 |
| 496103 | 2307 | 2323 | GGCACAGAAAAGTGAGG | 28 | 42278 | 42294 | 1158 |
| 496104 | 2398 | 2414 | AAAGTCTGACATGGTGC | 65 | 42369 | 42385 | 1159 |
| 496105 | 2399 | 2415 | AAAAGTCTGACATGGTG | 54 | 42370 | 42386 | 1160 |
| 496106 | 2400 | 2416 | CAAAAGTCTGACATGGT | 39 | 42371 | 42387 | 1161 |
| 496036 | 474 | 490 | GACCCACTGGAGCACTG | 49 | 25600 | 25616 | 1091 |
| 496037 | 475 | 491 | GGACCCACTGGAGCACT | 76 | 25601 | 25617 | 1092 |
| 496038 | 476 | 492 | AGGACCCACTGGAGCAC | 72 | 25602 | 25618 | 1093 |
| 496039 | 553 | 569 | CAGCGATGAGCCAGCAA | 67 | 31120 | 31136 | 1094 |
| 496040 | 554 | 570 | ACAGCGATGAGCCAGCA | 67 | 31121 | 31137 | 1095 |
| 496041 | 555 | 571 | CACAGCGATGAGCCAGC | 78 | 31122 | 31138 | 1096 |
| 496042 | 556 | 572 | GCACAGCGATGAGCCAG | 61 | 31123 | 31139 | 1097 |
| 496043 | 557 | 573 | AGCACAGCGATGAGCCA | 70 | 31124 | 31140 | 1098 |
| 496044 | 558 | 574 | GAGCACAGCGATGAGCC | 48 | 31125 | 31141 | 1099 |
| 496045 | 998 | 1014 | TTCTTGCCAGGCATGGA | 39 | 38151 | 38167 | 1100 |
| 496046 | 999 | 1015 | ATTCTTGCCAGGCATGG | 31 | 38152 | 38168 | 1101 |
| 413433 | n/a | n/a | GCCTGGACAAGTCCTGCCCA | 68 | 32431 | 32450 | 425 |
| 496107 | n/a | n/a | CAGGGCCCTTTCCAGAA | 34 | 10044 | 10060 | 1085 |
| 496108 | n/a | n/a | ACAGGGCCCTTTCCAGA | 39 | 10045 | 10061 | 1086 |
| 496109 | n/a | n/a | CACAGGGCCCTTTCCAG | 39 | 10046 | 10062 | 1087 |
| 496110 | n/a | n/a | CGAATATCCCTAATAAC | 14 | 10210 | 10226 | 1088 |
| 496111 | n/a | n/a | TCGAATATCCCTAATAA | 9 | 10211 | 10227 | 1089 |
| 496112 | n/a | n/a | CTCGAATATCCCTAATA | 17 | 10212 | 10228 | 1090 |

TABLE 20

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 483876 | 14332 | 14351 | GTGAGATCCCCAGAGAGGAA | 26 | 1162 |
| 483877 | 14337 | 14356 | AAGGAGTGAGATCCCCAGAG | 34 | 1163 |
| 483878 | 14360 | 14379 | TTCTGACCCTATTTTCCAGA | 52 | 1164 |
| 483879 | 14385 | 14404 | CCCTCCATCCTTGAGAATCT | 76 | 1165 |
| 483880 | 14427 | 14446 | ATGTCACAAGTTCACAAACA | 49 | 1166 |
| 483881 | 14432 | 14451 | CATGAATGTCACAAGTTCAC | 38 | 1167 |
| 483882 | 14437 | 14456 | ACTAACATGAATGTCACAAG | 35 | 1168 |
| 483883 | 14442 | 14461 | CAAGGACTAACATGAATGTC | 0 | 1169 |
| 483884 | 14447 | 14466 | AATGACAAGGACTAACATGA | 24 | 1170 |
| 483885 | 14452 | 14471 | GGACAAATGACAAGGACTAA | 12 | 1171 |
| 483886 | 14457 | 14476 | ACACAGGACAAATGACAAGG | 62 | 1172 |
| 483887 | 14462 | 14481 | GTGTAACACAGGACAAATGA | 82 | 1173 |
| 483888 | 14467 | 14486 | TGAATGTGTAACACAGGACA | 75 | 1174 |
| 483889 | 14503 | 14522 | CAGGGTCTGCCACTCTCTAC | 88 | 1175 |
| 483890 | 14508 | 14527 | TAGAGCAGGGTCTGCCACTC | 85 | 1176 |
| 483891 | 14532 | 14551 | TCAGTGAAGCCTTCCTGGAT | 31 | 1177 |
| 483892 | 14537 | 14556 | CTTCCTCAGTGAAGCCTTCC | 72 | 1178 |
| 483893 | 14542 | 14561 | AGTCCCTTCCTCAGTGAAGC | 59 | 1179 |
| 483894 | 14547 | 14566 | CCCCAAGTCCCTTCCTCAGT | 51 | 1180 |
| 483895 | 14648 | 14667 | CACAGTCATCTTGTGTACAT | 93 | 1181 |
| 483896 | 14653 | 14672 | CTCTGCACAGTCATCTTGTG | 59 | 1182 |
| 483897 | 14658 | 14677 | GATCACTCTGCACAGTCATC | 83 | 1183 |
| 483898 | 14663 | 14682 | GCTCAGATCACTCTGCACAG | 94 | 1184 |
| 483899 | 14668 | 14687 | TCATTGCTCAGATCACTCTG | 71 | 1185 |
| 483900 | 14673 | 14692 | TCCTGTCATTGCTCAGATCA | 81 | 1186 |
| 483901 | 14678 | 14697 | GTCTTTCCTGTCATTGCTCA | 86 | 1187 |
| 483902 | 14715 | 14734 | TCAGGGTGATCAAGCTCCCC | 70 | 1188 |
| 483903 | 14720 | 14739 | TGACCTCAGGGTGATCAAGC | 75 | 1189 |
| 483904 | 14725 | 14744 | TTCCCTGACCTCAGGGTGAT | 49 | 1190 |
| 483905 | 14730 | 14749 | AAGACTTCCCTGACCTCAGG | 46 | 1191 |
| 483906 | 14735 | 14754 | CCAGGAAGACTTCCCTGACC | 65 | 1192 |
| 483907 | 14740 | 14759 | CTCTTCCAGGAAGACTTCCC | 68 | 1193 |
| 483908 | 14745 | 14764 | GTCACCTCTTCCAGGAAGAC | 94 | 1194 |
| 483909 | 14750 | 14769 | TGAATGTCACCTCTTCCAGG | 84 | 1195 |
| 483910 | 14755 | 14774 | CGGACTGAATGTCACCTCTT | 95 | 1196 |
| 483911 | 14760 | 14779 | AGATCCGGACTGAATGTCAC | 79 | 1197 |

TABLE 20-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 483912 | 14765 | 14784 | TTTCCAGATCCGGACTGAAT | 79 | 1198 |
| 483913 | 14770 | 14789 | TCATCTTTCCAGATCCGGAC | 95 | 1199 |
| 483914 | 14775 | 14794 | TCTATTCATCTTTCCAGATC | 55 | 1200 |
| 483915 | 14802 | 14821 | TGAATGTTCTTGCCTGTCTT | 48 | 1201 |
| 483916 | 14807 | 14826 | GTACCTGAATGTTCTTGCCT | 85 | 1202 |
| 483917 | 14812 | 14831 | TTCCTGTACCTGAATGTTCT | 71 | 1203 |
| 483918 | 14852 | 14871 | TGCCTCTCCCATCCAAATCT | 75 | 1204 |
| 483919 | 14882 | 14901 | GTTGGTCACTCAGAGGCCCT | 86 | 1205 |
| 483920 | 14953 | 14972 | ACAGGCCTGGATCCAGCATC | 77 | 1206 |
| 483921 | 14986 | 15005 | TCTTCCTCCTGCTGCAGACA | 86 | 1207 |
| 483922 | 14991 | 15010 | TCAAGTCTTCCTCCTGCTGC | 68 | 1208 |
| 483923 | 14996 | 15015 | AGCTCTCAAGTCTTCCTCCT | 87 | 1209 |
| 483924 | 15001 | 15020 | CCATGAGCTCTCAAGTCTTC | 82 | 1210 |
| 483925 | 15006 | 15025 | CTTTCCCATGAGCTCTCAAG | 68 | 1211 |
| 483926 | 15011 | 15030 | GGCTCCTTTCCCATGAGCTC | 77 | 1212 |
| 483927 | 15016 | 15035 | CACCAGGCTCCTTTCCCATG | 84 | 1213 |
| 483928 | 15021 | 15040 | AACTGCACCAGGCTCCTTTC | 70 | 1214 |
| 483929 | 15026 | 15045 | AAACTAACTGCACCAGGCTC | 65 | 1215 |
| 483930 | 15031 | 15050 | CCAATAAACTAACTGCACCA | 36 | 1216 |
| 483931 | 15036 | 15055 | GGAGGCCAATAAACTAACTG | 37 | 1217 |
| 483932 | 15041 | 15060 | GTGCTGGAGGCCAATAAACT | 60 | 1218 |
| 483933 | 15046 | 15065 | TCAAAGTGCTGGAGGCCAAT | 66 | 1219 |
| 483934 | 15073 | 15092 | AGCCAGCAGCTCCATACCAG | 70 | 1220 |
| 483935 | 15078 | 15097 | AAATCAGCCAGCAGCTCCAT | 56 | 1221 |
| 483936 | 15083 | 15102 | CCCTCAAATCAGCCAGCAGC | 62 | 1222 |
| 483937 | 15088 | 15107 | TGAGGCCCTCAAATCAGCCA | 52 | 1223 |
| 483938 | 15093 | 15112 | GCCCATGAGGCCCTCAAATC | 44 | 1224 |
| 483939 | 15098 | 15117 | GCCCTGCCCATGAGGCCCTC | 44 | 1225 |
| 483940 | 15103 | 15122 | CCTGGGCCCTGCCCATGAGG | 28 | 1226 |
| 483941 | 15144 | 15163 | GCCAAGCAGGAGCTGGACAG | 35 | 1227 |
| 483942 | 15178 | 15197 | TAGTGGCTTGCTGAGGCTGC | 67 | 1228 |
| 483943 | 15183 | 15202 | AAGGGTAGTGGCTTGCTGAG | 31 | 1229 |
| 483944 | 15188 | 15207 | TAAGGAAGGGTAGTGGCTTG | 5 | 1230 |
| 483945 | 15199 | 15218 | GAGACTGAGGGTAAGGAAGG | 31 | 1231 |
| 483946 | 15204 | 15223 | ATGAGGAGACTGAGGGTAAG | 41 | 1232 |
| 483947 | 15209 | 15228 | CATAGATGAGGAGACTGAGG | 42 | 1233 |

TABLE 20-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 483948 | 15214 | 15233 | CATTTCATAGATGAGGAGAC | 71 | 1234 |
| 483949 | 15219 | 15238 | TTGCTCATTTCATAGATGAG | 78 | 1235 |
| 483950 | 15224 | 15243 | CACTTTTGCTCATTTCATAG | 74 | 1236 |
| 483951 | 15247 | 15266 | ATAATCTGCACAGGTTCTTA | 47 | 1237 |
| 483952 | 15252 | 15271 | GCACCATAATCTGCACAGGT | 92 | 1238 |
| 413433 | 32431 | 32450 | GCCTGGACAAGTCCTGCCCA | 87 | 425 |

TABLE 21

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 483953 | 17938 | 17957 | GGGTCTAGGTGAGTGAGAAA | 42 | 1239 |
| 483954 | 17960 | 17979 | ATCTGGACCTAATGTCTGCC | 71 | 1240 |
| 483955 | 17965 | 17984 | GGCCCATCTGGACCTAATGT | 41 | 1241 |
| 483956 | 17970 | 17989 | ACCTGGGCCCATCTGGACCT | 61 | 1242 |
| 483957 | 18042 | 18061 | CTCTTGGGCTCCTTGAGGCA | 33 | 1243 |
| 483958 | 18047 | 18066 | ACAGCCTCTTGGGCTCCTTG | 33 | 1244 |
| 483959 | 18052 | 18071 | TGTGAACAGCCTCTTGGGCT | 49 | 1245 |
| 483960 | 18057 | 18076 | AGAGGTGTGAACAGCCTCTT | 0 | 1246 |
| 483961 | 18078 | 18097 | GCCAGAAAGATGCCAGCTAA | 67 | 1247 |
| 483962 | 18083 | 18102 | AGAGAGCCAGAAAGATGCCA | 57 | 1248 |
| 483963 | 18113 | 18132 | AAAAGGGCCAGAATGTCTGG | 24 | 1249 |
| 483964 | 18136 | 18155 | TAAGGAATCTAAATAACTTA | 21 | 1250 |
| 483965 | 18141 | 18160 | TGTCATAAGGAATCTAAATA | 16 | 1251 |
| 483966 | 18146 | 18165 | AGGATTGTCATAAGGAATCT | 54 | 1252 |
| 483967 | 18151 | 18170 | AATCCAGGATTGTCATAAGG | 59 | 1253 |
| 483968 | 18156 | 18175 | GCTTTAATCCAGGATTGTCA | 80 | 1254 |
| 483969 | 18161 | 18180 | CCTTAGCTTTAATCCAGGAT | 86 | 1255 |
| 483970 | 18166 | 18185 | GTCCTCCTTAGCTTTAATCC | 80 | 1256 |
| 483971 | 18171 | 18190 | TCAGTGTCCTCCTTAGCTTT | 65 | 1257 |
| 483972 | 18176 | 18195 | GGGACTCAGTGTCCTCCTTA | 81 | 1258 |
| 483973 | 18181 | 18200 | TCCCTGGGACTCAGTGTCCT | 77 | 1259 |
| 483974 | 18220 | 18239 | GATTCTTACCTGCAATGAGA | 36 | 1260 |
| 483975 | 18225 | 18244 | GCTCTGATTCTTACCTGCAA | 70 | 1261 |
| 483976 | 18230 | 18249 | CCCTGGCTCTGATTCTTACC | 60 | 1262 |

TABLE 21-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 483977 | 18235 | 18254 | TCAAACCCTGGCTCTGATTC | 70 | 1263 |
| 483978 | 18240 | 18259 | AGGATTCAAACCCTGGCTCT | 72 | 1264 |
| 483979 | 18286 | 18305 | ATGCCTGCCCTGCCTAGGAA | 75 | 1265 |
| 483980 | 18291 | 18310 | AAATAATGCCTGCCCTGCCT | 37 | 1266 |
| 483981 | 18296 | 18315 | GGGTAAAATAATGCCTGCCC | 65 | 1267 |
| 483982 | 18301 | 18320 | TTGATGGGTAAAATAATGCC | 9 | 1268 |
| 483983 | 18306 | 18325 | CCTGTTTGATGGGTAAAATA | 60 | 1269 |
| 483984 | 18311 | 18330 | CCTCTCCTGTTTGATGGGTA | 89 | 1270 |
| 483985 | 18316 | 18335 | GGTGTCCTCTCCTGTTTGAT | 78 | 1271 |
| 483986 | 18321 | 18340 | GCCTCGGTGTCCTCTCCTGT | 84 | 1272 |
| 483987 | 18326 | 18345 | AGTAAGCCTCGGTGTCCTCT | 87 | 1273 |
| 483988 | 18331 | 18350 | TACCAAGTAAGCCTCGGTGT | 87 | 1274 |
| 483989 | 18336 | 18355 | TTAATTACCAAGTAAGCCTC | 74 | 1275 |
| 483990 | 18369 | 18388 | TTCATAAAAAGTAAAGATCT | 51 | 1276 |
| 483991 | 18374 | 18393 | AGAGCTTCATAAAAAGTAAA | 0 | 1277 |
| 483992 | 18379 | 18398 | AGCCAAGAGCTTCATAAAAA | 87 | 1278 |
| 483993 | 18417 | 18436 | TCACCAGATTGTTGTGGGAA | 84 | 1279 |
| 483994 | 18422 | 18441 | CTACCTCACCAGATTGTTGT | 75 | 1280 |
| 483995 | 18427 | 18446 | AATACCTACCTCACCAGATT | 63 | 1281 |
| 483996 | 18432 | 18451 | GGGCTAATACCTACCTCACC | 81 | 1282 |
| 483997 | 18450 | 18469 | TTCCTCATCTATACAGTGGG | 85 | 1283 |
| 483998 | 18455 | 18474 | TCAGCTTCCTCATCTATACA | 52 | 1284 |
| 483999 | 18460 | 18479 | AAGCTTCAGCTTCCTCATCT | 35 | 1285 |
| 484000 | 18465 | 18484 | TATACAAGCTTCAGCTTCCT | 44 | 1286 |
| 484001 | 18470 | 18489 | CTTCCTATACAAGCTTCAGC | 77 | 1287 |
| 484002 | 18475 | 18494 | AGTCACTTCCTATACAAGCT | 64 | 1288 |
| 484003 | 18513 | 18532 | AGAACCTGGCCTCTAACTCG | 42 | 1289 |
| 484004 | 18581 | 18600 | CATACTGGCATCTGGCAGGG | 84 | 1290 |
| 484005 | 18586 | 18605 | ACCTCCATACTGGCATCTGG | 66 | 1291 |
| 484006 | 18591 | 18610 | ACCTCACCTCCATACTGGCA | 79 | 1292 |
| 484007 | 18747 | 18766 | ATGAAGAAAAATAATTTGGG | 0 | 1293 |
| 484008 | 18821 | 18840 | TTAACTTCTGCTGAGGGAGA | 63 | 1294 |
| 484009 | 18826 | 18845 | GATGCTTAACTTCTGCTGAG | 68 | 1295 |
| 484010 | 18831 | 18850 | GTTAGGATGCTTAACTTCTG | 78 | 1296 |
| 484011 | 18836 | 18855 | GTTAAGTTAGGATGCTTAAC | 65 | 1297 |

TABLE 21-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484012 | 18869 20779 | 18888 20798 | ATAGGCCTGGATGCCCAAGT | 78 | 1298 |
| 484013 | 18880 20790 | 18899 20809 | CAGAGGCAGCTATAGGCCTG | 69 | 1299 |
| 484014 | 18885 | 18904 | TGCCTCAGAGGCAGCTATAG | 30 | 1300 |
| 484015 | 18890 | 18909 | TGTCCTGCCTCAGAGGCAGC | 65 | 1301 |
| 484016 | 18895 | 18914 | GATGATGTCCTGCCTCAGAG | 61 | 1302 |
| 484017 | 18900 | 18919 | CAGCAGATGATGTCCTGCCT | 85 | 1303 |
| 484018 | 18982 | 19001 | GGGACAGAGCTAAGACCCAA | 58 | 1304 |
| 484019 | 19013 | 19032 | GTCAAAGGTGGCTTCCTGGG | 74 | 1305 |
| 484020 | 19018 | 19037 | GAGTAGTCAAAGGTGGCTTC | 78 | 1306 |
| 484021 | 19023 | 19042 | GGAATGAGTAGTCAAAGGTG | 27 | 1307 |
| 484022 | 19028 | 19047 | AAGTTGGAATGAGTAGTCAA | 14 | 1308 |
| 484023 | 19041 | 19060 | GCTGAGAATAAAGAAGTTGG | 55 | 1309 |
| 484024 | 19046 | 19065 | TAGAAGCTGAGAATAAAGAA | 36 | 1310 |
| 484025 | 19051 | 19070 | TGAAATAGAAGCTGAGAATA | 20 | 1311 |
| 484026 | 19112 | 19131 | GGAGTTCTAATGAGGCAGAC | 50 | 1312 |
| 484027 | 19117 | 19136 | TGCAGGGAGTTCTAATGAGG | 53 | 1313 |
| 484028 | 19122 | 19141 | AGCCTTGCAGGGAGTTCTAA | 62 | 1314 |
| 484029 | 19127 | 19146 | AACAAAGCCTTGCAGGGAGT | 30 | 1315 |
| 413433 | 32431 | 32450 | GCCTGGACAAGTCCTGCCCA | 76 | 425 |

TABLE 22

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484030 | 22439 | 22458 | ATGGCAAGTGCTTCCGTGGG | 79 | 1316 |
| 484031 | 22444 | 22463 | ACCAAATGGCAAGTGCTTCC | 82 | 1317 |
| 484032 | 22449 | 22468 | CAAATACCAAATGGCAAGTG | 34 | 1318 |
| 484033 | 22474 | 22493 | CTGCAAGGTGGTGAGCTCTA | 28 | 1319 |
| 484034 | 22513 | 22532 | CCTCACTTCCCATCTGCCTG | 24 | 1320 |
| 484035 | 22518 | 22537 | TGAACCCTCACTTCCCATCT | 14 | 1321 |
| 484036 | 22523 | 22542 | CCAAGTGAACCCTCACTTCC | 12 | 1322 |
| 484037 | 22528 | 22547 | GTCTACCAAGTGAACCCTCA | 20 | 1323 |
| 484038 | 22533 | 22552 | ATGCAGTCTACCAAGTGAAC | 39 | 1324 |

TABLE 22-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484039 | 22538 | 22557 | GGGAAATGCAGTCTACCAAG | 55 | 1325 |
| 484040 | 22543 | 22562 | CAAGTGGGAAATGCAGTCTA | 53 | 1326 |
| 484041 | 22548 | 22567 | GCCAACAAGTGGGAAATGCA | 85 | 1327 |
| 484042 | 22573 | 22592 | CCAACTACCGCCCACAGCTC | 43 | 1328 |
| 484043 | 22578 | 22597 | CAGCCCCAACTACCGCCCAC | 29 | 1329 |
| 484044 | 22583 | 22602 | TTATCCAGCCCCAACTACCG | 10 | 1330 |
| 484045 | 22588 | 22607 | CTGCCTTATCCAGCCCCAAC | 43 | 1331 |
| 484046 | 22593 | 22612 | TCACCCTGCCTTATCCAGCC | 51 | 1332 |
| 484047 | 22713 | 22732 | TCTTGTTCAACCCTCACCCC | 45 | 1333 |
| 484048 | 22766 | 22785 | CTTATTAGGTGTCTTAAAAT | 43 | 1334 |
| 484049 | 22771 | 22790 | CTAAGCTTATTAGGTGTCTT | 85 | 1335 |
| 484050 | 22776 | 22795 | CTCTGCTAAGCTTATTAGGT | 69 | 1336 |
| 484051 | 22820 | 22839 | ACTGAGAAGACCTAAAAATT | 0 | 1337 |
| 484052 | 22825 | 22844 | AAACAACTGAGAAGACCTAA | 45 | 1338 |
| 484053 | 22830 | 22849 | AACTGAAACAACTGAGAAGA | 32 | 1339 |
| 484054 | 22835 | 22854 | TCCCCAACTGAAACAACTGA | 65 | 1340 |
| 484055 | 22841 | 22860 | GACATATCCCCAACTGAAAC | 67 | 1341 |
| 484056 | 22846 | 22865 | CTGATGACATATCCCCAACT | 71 | 1342 |
| 484057 | 22851 | 22870 | TTTCACTGATGACATATCCC | 69 | 1343 |
| 484058 | 22856 | 22875 | AGAAATTTCACTGATGACAT | 56 | 1344 |
| 484059 | 22861 | 22880 | AGTATAGAAATTTCACTGAT | 18 | 1345 |
| 484060 | 22866 | 22885 | GGAGGAGTATAGAAATTTCA | 53 | 1346 |
| 484061 | 22871 | 22890 | TTGGAGGAGGAGTATAGAAA | 48 | 1347 |
| 484062 | 22876 | 22895 | GCAGCTTGGAGGAGGAGTAT | 32 | 1348 |
| 484063 | 22881 | 22900 | CCCATGCAGCTTGGAGGAGG | 68 | 1349 |
| 484064 | 22886 | 22905 | CAGCCCCCATGCAGCTTGGA | 84 | 1350 |
| 484065 | 22891 | 22910 | AGGGCCAGCCCCCATGCAGC | 67 | 1351 |
| 484066 | 22916 | 22935 | TTATCTAGCTCCCTACCTTG | 57 | 1352 |
| 484067 | 22968 | 22987 | TGAAGCCAGTGGTTTGAGGG | 30 | 1353 |
| 484068 | 22992 | 23011 | TGCTTCCCGTTGCAGACAGG | 34 | 1354 |
| 484069 | 23095 | 23114 | GTCCAAACACTCAGGTAGGG | 72 | 1355 |
| 484070 | 23100 | 23119 | CTTCAGTCCAAACACTCAGG | 85 | 1356 |
| 484071 | 23128 | 23147 | TTAAGTCTGAGAAACACCAC | 77 | 1357 |
| 484072 | 23133 | 23152 | GGTGATTAAGTCTGAGAAAC | 64 | 1358 |
| 484073 | 23138 | 23157 | CCCCAGGTGATTAAGTCTGA | 73 | 1359 |
| 484074 | 23143 | 23162 | AAGATCCCCAGGTGATTAAG | 26 | 1360 |

TABLE 22-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484075 | 23148 | 23167 | TTAACAAGATCCCCAGGTGA | 22 | 1361 |
| 484076 | 23154 | 23173 | TGCATTTTAACAAGATCCCC | 0 | 1362 |
| 484077 | 23159 | 23178 | AAATCTGCATTTTAACAAGA | 20 | 1363 |
| 484078 | 23164 | 23183 | AATCAAAATCTGCATTTTAA | 40 | 1364 |
| 484079 | 23169 | 23188 | TACTGAATCAAAATCTGCAT | 53 | 1365 |
| 484080 | 23174 | 23193 | GGATTTACTGAATCAAAATC | 31 | 1366 |
| 484081 | 23179 | 23198 | AGACTGGATTTACTGAATCA | 65 | 1367 |
| 484082 | 23184 | 23203 | GCTCCAGACTGGATTTACTG | 72 | 1368 |
| 484083 | 23232 | 23251 | AGCAGCATCAGCATCACCTG | 79 | 1369 |
| 484084 | 23237 | 23256 | GGAACAGCAGCATCAGCATC | 39 | 1370 |
| 484085 | 23242 | 23261 | GTCTGGGAACAGCAGCATCA | 90 | 1371 |
| 484086 | 23271 | 23290 | TACTCTAGCACTTTCCTACT | 53 | 1372 |
| 484087 | 23276 | 23295 | AAATGTACTCTAGCACTTTC | 41 | 1373 |
| 484088 | 23281 | 23300 | AGACAAAATGTACTCTAGCA | 58 | 1374 |
| 484089 | 23305 | 23324 | GGCTGGATGCCCTGGCTAGA | 79 | 1375 |
| 484090 | 23310 | 23329 | AGGCAGGCTGGATGCCCTGG | 55 | 1376 |
| 484091 | 23315 | 23334 | ATCTGAGGCAGGCTGGATGC | 59 | 1377 |
| 484092 | 23417 | 23436 | ATCTTCCAGCAGCTGGCTCT | 28 | 1378 |
| 484093 | 23422 | 23441 | AAGTCATCTTCCAGCAGCTG | 41 | 1379 |
| 484094 | 23427 | 23446 | TGGACAAGTCATCTTCCAGC | 85 | 1380 |
| 484095 | 23470 | 23489 | AAGTCCAAGCACAGGCTTGA | 44 | 1381 |
| 484096 | 23475 | 23494 | AAGTGAAGTCCAAGCACAGG | 39 | 1382 |
| 484097 | 23480 | 23499 | GAGGGAAGTGAAGTCCAAGC | 63 | 1383 |
| 484098 | 23547 | 23566 | TCCTTGAGGGTCTCATAACC | 66 | 1384 |
| 484099 | 23552 | 23571 | GCTTATCCTTGAGGGTCTCA | 84 | 1385 |
| 484100 | 23557 | 23576 | CACATGCTTATCCTTGAGGG | 82 | 1386 |
| 484101 | 23562 | 23581 | TTCATCACATGCTTATCCTT | 75 | 1387 |
| 484102 | 23567 | 23586 | ATGAGTTCATCACATGCTTA | 78 | 1388 |
| 484103 | 23597 | 23616 | TCAACCTGCCCAGCAGTGGG | 62 | 1389 |
| 484104 | 23641 | 23660 | CTCTGTACACAGGACACAGT | 70 | 1390 |
| 484105 | 23646 | 23665 | AAAGGCTCTGTACACAGGAC | 79 | 1391 |
| 484106 | 23651 | 23670 | AGTGCAAAGGCTCTGTACAC | 66 | 1392 |
| 413433 | 32431 | 32450 | GCCTGGACAAGTCCTGCCCA | 86 | 425 |

TABLE 23

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 413433 | 32431 | 32450 | GCCTGGACAAGTCCTGCCCA | 84 | 425 |
| 484107 | 26390 | 26409 | GGCAACCTAAGGAGTGAGGG | 71 | 1393 |
| 484108 | 26395 | 26414 | TGGATGGCAACCTAAGGAGT | 40 | 1394 |
| 484109 | 26400 | 26419 | TGGCCTGGATGGCAACCTAA | 57 | 1395 |
| 484110 | 26479 | 26498 | GCTATGCTGAGAGCACAGGG | 79 | 1396 |
| 484111 | 26484 | 26503 | TACCTGCTATGCTGAGAGCA | 71 | 1397 |
| 484112 | 26489 | 26508 | GAAGCTACCTGCTATGCTGA | 46 | 1398 |
| 484113 | 26494 | 26513 | CTGAGGAAGCTACCTGCTAT | 36 | 1399 |
| 484114 | 26516 | 26535 | CAGGTTCATCTGCCTTGACG | 70 | 1400 |
| 484115 | 26521 | 26540 | TGGAGCAGGTTCATCTGCCT | 83 | 1401 |
| 484116 | 26526 | 26545 | TGCTCTGGAGCAGGTTCATC | 81 | 1402 |
| 484117 | 26531 | 26550 | TGTGATGCTCTGGAGCAGGT | 80 | 1403 |
| 484118 | 26536 | 26555 | CACTCTGTGATGCTCTGGAG | 74 | 1404 |
| 484119 | 26541 | 26560 | GAATGCACTCTGTGATGCTC | 68 | 1405 |
| 484120 | 26566 | 26585 | CAGAGGGACTGGCTCACAGG | 21 | 1406 |
| 484121 | 26590 | 26609 | TACAGTCCCGAAGAGTGGGT | 38 | 1407 |
| 484122 | 26595 | 26614 | GCCTATACAGTCCCGAAGAG | 51 | 1408 |
| 484123 | 26600 | 26619 | TACCAGCCTATACAGTCCCG | 60 | 1409 |
| 484124 | 26605 | 26624 | TCCCTACCAGCCTATACAG | 59 | 1410 |
| 484125 | 26610 | 26629 | GATGATCCCTACCAGCCTA | 68 | 1411 |
| 484126 | 26615 | 26634 | GTCCTGATGATCCCCTACCA | 80 | 1412 |
| 484127 | 26620 | 26639 | GGTAAGTCCTGATGATCCCC | 86 | 1413 |
| 484128 | 26625 | 26644 | GACATGGTAAGTCCTGATGA | 54 | 1414 |
| 484129 | 26630 | 26649 | GCACTGACATGGTAAGTCCT | 87 | 1415 |
| 484130 | 26635 | 26654 | GCTCAGCACTGACATGGTAA | 85 | 1416 |
| 484131 | 26640 | 26659 | CAGCTGCTCAGCACTGACAT | 80 | 1417 |
| 484132 | 26645 | 26664 | AAGGACAGCTGCTCAGCACT | 60 | 1418 |
| 484133 | 26711 | 26730 | GTGAAGTTCTATCCCTTGGC | 89 | 1419 |
| 484134 | 26716 | 26735 | CACCTGTGAAGTTCTATCCC | 69 | 1420 |
| 484135 | 26721 | 26740 | TTTCTCACCTGTGAAGTTCT | 79 | 1421 |
| 484136 | 26755 | 26774 | AGCAGGTAGTTGATGAACCT | 70 | 1422 |
| 484137 | 26778 | 26797 | TGCCATTTAATGAGCTTCAC | 86 | 1423 |
| 484138 | 26783 | 26802 | AACTCTGCCATTTAATGAGC | 55 | 1424 |
| 484139 | 26788 | 26807 | ATCCCAACTCTGCCATTTAA | 81 | 1425 |
| 484140 | 26811 | 26830 | GAATGCACTGAGTTTCTGCT | 89 | 1426 |
| 484141 | 26849 | 26868 | CACTAATTCTGGGCTTCCAG | 87 | 1427 |

TABLE 23-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484142 | 26854 | 26873 | CAGTTCACTAATTCTGGGCT | 79 | 1428 |
| 484143 | 26859 | 26878 | AGCCCCAGTTCACTAATTCT | 52 | 1429 |
| 484144 | 26864 | 26883 | GTTTCAGCCCCAGTTCACTA | 54 | 1430 |
| 484145 | 26869 | 26888 | TGGCTGTTTCAGCCCCAGTT | 70 | 1431 |
| 484146 | 26874 | 26893 | AAGACTGGCTGTTTCAGCCC | 79 | 1432 |
| 484147 | 26879 | 26898 | AGGTGAAGACTGGCTGTTTC | 76 | 1433 |
| 484148 | 26884 | 26903 | CCTAAAGGTGAAGACTGGCT | 91 | 1434 |
| 484149 | 26889 | 26908 | TTGGGCCTAAAGGTGAAGAC | 64 | 1435 |
| 484150 | 26894 | 26913 | CGTTCTTGGGCCTAAAGGTG | 57 | 1436 |
| 484151 | 26899 | 26918 | AAGCCCGTTCTTGGGCCTAA | 23 | 1437 |
| 484152 | 26926 | 26945 | TTAAGGGTTCATGGATCCCC | 66 | 1438 |
| 484153 | 26931 | 26950 | TAATTTTAAGGGTTCATGGA | 29 | 1439 |
| 484154 | 27005 | 27024 | CTGTAAGACTTTGAGGACAG | 60 | 1440 |
| 484155 | 27010 | 27029 | TGTCCCTGTAAGACTTTGAG | 43 | 1441 |
| 484156 | 27046 | 27065 | GTTCTTCCAACCAGTGTTTG | 84 | 1442 |
| 484157 | 27051 | 27070 | GCTCAGTTCTTCCAACCAGT | 94 | 1443 |
| 484158 | 27056 | 27075 | AGTTTGCTCAGTTCTTCCAA | 85 | 1444 |
| 484159 | 27061 | 27080 | TGTTTAGTTTGCTCAGTTCT | 68 | 1445 |
| 484160 | 27101 | 27120 | AAATGCAAGCCATGTTAGGG | 54 | 1446 |
| 484161 | 27106 | 27125 | TGGCCAAATGCAAGCCATGT | 72 | 1447 |
| 484162 | 27111 | 27130 | GTAAGTGGCCAAATGCAAGC | 67 | 1448 |
| 484163 | 27116 | 27135 | TTCTAGTAAGTGGCCAAATG | 57 | 1449 |
| 484164 | 27174 | 27193 | CAGGCCTCCACTTCCTTTTT | 66 | 1450 |
| 484165 | 27211 | 27230 | TCTTCTCATGTGACCCCAAG | 69 | 1451 |
| 484166 | 27216 | 27235 | TACTTTCTTCTCATGTGACC | 59 | 1452 |
| 484167 | 27221 | 27240 | CCCAGTACTTTCTTCTCATG | 85 | 1453 |
| 484168 | 27226 | 27245 | CTGGTCCCAGTACTTTCTTC | 63 | 1454 |
| 484169 | 27231 | 27250 | TTGTCCTGGTCCCAGTACTT | 86 | 1455 |
| 484170 | 27236 | 27255 | GGTTCTTGTCCTGGTCCCAG | 90 | 1456 |
| 484171 | 27241 | 27260 | CCCTGGGTTCTTGTCCTGGT | 82 | 1457 |
| 484172 | 27246 | 27265 | GGAGTCCCTGGGTTCTTGTC | 74 | 1458 |
| 484173 | 27251 | 27270 | AGGCTGGAGTCCCTGGGTTC | 53 | 1459 |
| 484174 | 27256 | 27275 | CTGGGAGGCTGGAGTCCCTG | 55 | 1460 |
| 484175 | 27352 | 27371 | ACCAGCAGGCCCAGACCCA | 34 | 1461 |
| 484176 | 27357 | 27376 | TCCCTACCAGCCAGGCCCAG | 17 | 1462 |

TABLE 23-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484177 | 27362 | 27381 | TCAGCTCCCTACCAGCCAGG | 47 | 1463 |
| 484178 | 27367 | 27386 | GCTGCTCAGCTCCCTACCAG | 74 | 1464 |
| 484179 | 27372 | 27391 | TACAAGCTGCTCAGCTCCCT | 67 | 1465 |
| 484180 | 27377 | 27396 | TGTTCTACAAGCTGCTCAGC | 73 | 1466 |
| 484181 | 27382 | 27401 | GCTGGTGTTCTACAAGCTGC | 92 | 1467 |
| 484182 | 27387 | 27406 | CGTGAGCTGGTGTTCTACAA | 80 | 1468 |
| 484183 | 27437 | 27456 | TCTGATCAATTATTAACCTA | 21 | 1469 |

TABLE 24

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484184 | 29480 | 29499 | TGGATGTAGACTCTCCATGA | 61 | 1470 |
| 484185 | 29485 | 29504 | AAGGCTGGATGTAGACTCTC | 72 | 1471 |
| 484186 | 29490 | 29509 | AAGATAAGGCTGGATGTAGA | 28 | 1472 |
| 484187 | 29495 | 29514 | GGGAGAAGATAAGGCTGGAT | 50 | 1473 |
| 484188 | 29500 | 29519 | CCCATGGGAGAAGATAAGGC | 62 | 1474 |
| 484189 | 29505 | 29524 | GGTTTCCCATGGGAGAAGAT | 50 | 1475 |
| 484190 | 29538 | 29557 | CATGCTCTCTTCTCACCATG | 71 | 1476 |
| 484191 | 29543 | 29562 | GATGTCATGCTCTCTTCTCA | 66 | 1477 |
| 484192 | 29548 | 29567 | CTCTGGATGTCATGCTCTCT | 82 | 1478 |
| 484193 | 29570 | 29589 | CCAGGTGCTGTAGGCTGCCT | 84 | 1479 |
| 484194 | 29575 | 29594 | TGGTCCCAGGTGCTGTAGGC | 75 | 1480 |
| 484195 | 29580 | 29599 | CCTGGTGGTCCCAGGTGCTG | 62 | 1481 |
| 484196 | 29607 | 29626 | AGGCCAACCCTTGCTGTGTG | 63 | 1482 |
| 484197 | 29612 | 29631 | AAGGGAGGCCAACCCTTGCT | 60 | 1483 |
| 484198 | 29635 | 29654 | TAGGACTTTTTCCACTGCCC | 72 | 1484 |
| 484199 | 29640 | 29659 | CCTTCTAGGACTTTTTCCAC | 41 | 1485 |
| 484200 | 29663 | 29682 | GTTTGGTGGAGAAGCATGG | 25 | 1486 |
| 484201 | 29668 | 29687 | CTCATGTTTGGTGGGAGAAG | 45 | 1487 |
| 484202 | 29673 | 29692 | AGGTACTCATGTTTGGTGGG | 77 | 1488 |
| 484203 | 29678 | 29697 | GCAGCAGGTACTCATGTTTG | 86 | 1489 |
| 484204 | 29683 | 29702 | CAAGGGCAGCAGGTACTCAT | 81 | 1490 |
| 484205 | 29762 | 29781 | ACATATCATCTCTTGCCTGT | 59 | 1491 |

TABLE 24-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484206 | 29767 | 29786 | TATCTACATATCATCTCTTG | 31 | 1492 |
| 484207 | 29772 | 29791 | CATACTATCTACATATCATC | 10 | 1493 |
| 484208 | 29777 | 29796 | AATATCATACTATCTACATA | 21 | 1494 |
| 484209 | 29782 | 29801 | TCCCCAATATCATACTATCT | 84 | 1495 |
| 484210 | 29804 | 29823 | ACCTCAGCTCTTCAAGAAGT | 61 | 1496 |
| 484211 | 29809 | 29828 | CTCAGACCTCAGCTCTTCAA | 76 | 1497 |
| 484212 | 29814 | 29833 | CCTATCTCAGACCTCAGCTC | 58 | 1498 |
| 484213 | 29819 | 29838 | TAAGGCCTATCTCAGACCTC | 66 | 1499 |
| 484214 | 29824 | 29843 | ACCTTTAAGGCCTATCTCAG | 4 | 1500 |
| 484215 | 29829 | 29848 | ACCCAACCTTTAAGGCCTAT | 86 | 1501 |
| 484216 | 29834 | 29853 | TTTTTACCCAACCTTTAAGG | 53 | 1502 |
| 484217 | 29839 | 29858 | TCCATTTTTTACCCAACCTT | 87 | 1503 |
| 484218 | 29844 | 29863 | CTCTTTCCATTTTTTACCCA | 80 | 1504 |
| 484219 | 29849 | 29868 | CTTCTCTCTTTCCATTTTTT | 75 | 1505 |
| 484220 | 29854 | 29873 | CAGGGCTTCTCTCTTTCCAT | 83 | 1506 |
| 484221 | 29859 | 29878 | CTCAGCAGGGCTTCTCTCTT | 66 | 1507 |
| 484222 | 29864 | 29883 | CTGCCCTCAGCAGGGCTTCT | 0 | 1508 |
| 484223 | 29869 | 29888 | ACTAGCTGCCCTCAGCAGGG | 28 | 1509 |
| 484224 | 29902 | 29921 | TTGTGCCATGCCTGCTTTAT | 39 | 1510 |
| 484225 | 30358 | 30377 | GCAGAGCCCATCAGCCTCCC | 44 | 1511 |
| 484226 | 30363 | 30382 | AAAGCGCAGAGCCCATCAGC | 48 | 1512 |
| 484227 | 30407 | 30426 | CTGGCTCCCTTCCAACATAA | 64 | 1513 |
| 484228 | 30412 | 30431 | GAGGGCTGGCTCCCTTCCAA | 41 | 1514 |
| 484229 | 30417 | 30436 | AGGAGGAGGGCTGGCTCCCT | 12 | 1515 |
| 484230 | 30422 | 30441 | TGCCCAGGAGGAGGGCTGGC | 4 | 1516 |
| 484231 | 30483 | 30502 | TAGGCTTTAGAAATTCACCA | 91 | 1517 |
| 484232 | 30514 | 30533 | CAGGTCTGACTCTACAGTCC | 78 | 1518 |
| 484233 | 30519 | 30538 | AAACACAGGTCTGACTCTAC | 55 | 1519 |
| 484234 | 30524 | 30543 | GATTCAAACACAGGTCTGAC | 62 | 1520 |
| 484235 | 30529 | 30548 | GCCAGGATTCAAACACAGGT | 82 | 1521 |
| 484236 | 30534 | 30553 | GCAGAGCCAGGATTCAAACA | 55 | 1522 |
| 484237 | 30539 | 30558 | CAGTGGCAGAGCCAGGATTC | 66 | 1523 |
| 484238 | 30544 | 30563 | CAGGACAGTGGCAGAGCCAG | 27 | 1524 |
| 484239 | 30549 | 30568 | CCCAGCAGGACAGTGGCAGA | 39 | 1525 |
| 484240 | 30554 | 30573 | GGTCACCCAGCAGGACAGTG | 65 | 1526 |

TABLE 24-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484241 | 30559 | 30578 | CCCAAGGTCACCCAGCAGGA | 76 | 1527 |
| 484242 | 30564 | 30583 | ACTTGCCCAAGGTCACCCAG | 68 | 1528 |
| 484243 | 30569 | 30588 | AGATAACTTGCCCAAGGTCA | 62 | 1529 |
| 484244 | 30610 | 30629 | TTGCCCCATTTTAGAGATAA | 26 | 1530 |
| 484245 | 30615 | 30634 | TGACTTTGCCCCATTTTAGA | 0 | 1531 |
| 484246 | 30621 | 30640 | GCAGGGTGACTTTGCCCCAT | 35 | 1532 |
| 484247 | 30644 | 30663 | TGAGCCACTGTCTCAAGTGT | 42 | 1533 |
| 484248 | 30669 | 30688 | TGCCTCTGCATCTCAAGACT | 75 | 1534 |
| 484249 | 30674 | 30693 | CCCAGTGCCTCTGCATCTCA | 83 | 1535 |
| 484250 | 30712 | 30731 | CCAGCCCAGACACTGTGGAT | 60 | 1536 |
| 484251 | 30717 | 30736 | AGCACCCAGCCCAGACACTG | 59 | 1537 |
| 484252 | 30749 | 30768 | TACTGTCCCCTCCTTGTGTG | 16 | 1538 |
| 484253 | 30773 | 30792 | TTCAGCTTCTTGTGAAGCTG | 0 | 1539 |
| 484254 | 30778 | 30797 | TAGGCTTCAGCTTCTTGTGA | 25 | 1540 |
| 484255 | 30783 | 30802 | GGAGATAGGCTTCAGCTTCT | 58 | 1541 |
| 484256 | 30788 | 30807 | CCAAAGGAGATAGGCTTCAG | 49 | 1542 |
| 484257 | 30887 | 30906 | AGCAGATTCCTGGGACAAGA | 62 | 1543 |
| 484258 | 30922 | 30941 | GAGAAATAGCTACAGGAATG | 36 | 1544 |
| 484259 | 30927 | 30946 | ACCCTGAGAAATAGCTACAG | 22 | 1545 |
| 484260 | 30932 | 30951 | CACAAACCCTGAGAAATAGC | 0 | 1546 |
| 413433 | 32431 | 32450 | GCCTGGACAAGTCCTGCCCA | 88 | 425 |

TABLE 25

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484261 | 32253 | 32272 | AAGACTGGGCTTAGGCTAAG | 50 | 1547 |
| 484262 | 32303 | 32322 | TCAGGAAAAGGAGAAGGAAC | 36 | 1548 |
| 484263 | 32336 | 32355 | AGCTTCAAATTTTCTGCAGT | 72 | 1549 |
| 484264 | 32399 | 32418 | AGTTTCTTTACCTCCAAAAT | 48 | 1550 |
| 413433 | 32431 | 32450 | GCCTGGACAAGTCCTGCCCA | 87 | 425 |
| 423463 | 32432 | 32451 | AGCCTGGACAAGTCCTGCCC | 90 | 467 |
| 423464 | 32433 | 32452 | CAGCCTGGACAAGTCCTGCC | 86 | 468 |
| 423465 | 32434 | 32453 | GCAGCCTGGACAAGTCCTGC | 74 | 469 |

TABLE 25-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484265 | 32436 | 32455 | ATGCAGCCTGGACAAGTCCT | 74 | 1551 |
| 484266 | 32441 | 32460 | AGACTATGCAGCCTGGACAA | 63 | 1552 |
| 484267 | 32446 | 32465 | ATACTAGACTATGCAGCCTG | 82 | 1553 |
| 484268 | 32451 | 32470 | CCATCATACTAGACTATGCA | 87 | 1554 |
| 484269 | 32456 | 32475 | TGTTGCCATCATACTAGACT | 83 | 1555 |
| 484270 | 32461 | 32480 | TGCAATGTTGCCATCATACT | 89 | 1556 |
| 484271 | 32466 | 32485 | GTGGTTGCAATGTTGCCATC | 90 | 1557 |
| 484272 | 32471 | 32490 | GGATGGTGGTTGCAATGTTG | 55 | 1558 |
| 484273 | 32476 | 32495 | AGCCTGGATGGTGGTTGCAA | 86 | 1559 |
| 484274 | 32481 | 32500 | CAATAAGCCTGGATGGTGGT | 79 | 1560 |
| 484275 | 32486 | 32505 | GAATTCAATAAGCCTGGATG | 66 | 1561 |
| 484276 | 32510 | 32529 | TCAGTGGAAAAGAACCTGGG | 71 | 1562 |
| 484277 | 32515 | 32534 | GGAAATCAGTGGAAAAGAAC | 55 | 1563 |
| 484278 | 32520 | 32539 | CAGTAGGAAATCAGTGGAAA | 54 | 1564 |
| 484279 | 32525 | 32544 | ACAGGCAGTAGGAAATCAGT | 51 | 1565 |
| 484280 | 32530 | 32549 | GAGAAACAGGCAGTAGGAAA | 56 | 1566 |
| 484281 | 32586 | 32605 | GACCCAGGAAGCTGGAATCA | 66 | 1567 |
| 484282 | 32591 | 32610 | AGGGAGACCCAGGAAGCTGG | 60 | 1568 |
| 484283 | 32619 | 32638 | ACTGAGATCTCCAGCAGCAA | 90 | 1569 |
| 484284 | 32645 | 32664 | AATGGAGTGACAGGGCAGGA | 82 | 1570 |
| 484285 | 32670 | 32689 | AGGGAGCAATGGTGGCAGGT | 71 | 1571 |
| 484286 | 32675 | 32694 | TGGACAGGGAGCAATGGTGG | 46 | 1572 |
| 484287 | 32680 | 32699 | TGCACTGGACAGGGAGCAAT | 36 | 1573 |
| 484288 | 32685 | 32704 | AGCCCTGCACTGGACAGGGA | 41 | 1574 |
| 484289 | 32706 | 32725 | TTGTGTCCCCATGCCCAGCA | 58 | 1575 |
| 484290 | 32711 | 32730 | CTGACTTGTGTCCCCATGCC | 78 | 1576 |
| 484291 | 32716 | 32735 | CAGGGCTGACTTGTGTCCCC | 52 | 1577 |
| 484292 | 32752 | 32771 | ACAAAGTCTATCAGGATGCA | 83 | 1578 |
| 484293 | 32757 | 32776 | AAGTGACAAAGTCTATCAGG | 83 | 1579 |
| 484294 | 32781 | 32800 | GTCTGCCCATGGCCCCATGG | 31 | 1580 |
| 484295 | 32786 | 32805 | AGAAAGTCTGCCCATGGCCC | 45 | 1581 |
| 484296 | 32791 | 32810 | GCTTGAGAAAGTCTGCCCAT | 35 | 1582 |
| 484297 | 32796 | 32815 | AGCAGGCTTGAGAAAGTCTG | 18 | 1583 |
| 484298 | 32801 | 32820 | GGCTCAGCAGGCTTGAGAAA | 60 | 1584 |
| 484299 | 32806 | 32825 | GATGAGGCTCAGCAGGCTTG | 68 | 1585 |

TABLE 25-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484300 | 32811 | 32830 | TTGCAGATGAGGCTCAGCAG | 48 | 1586 |
| 484301 | 32816 | 32835 | CCATTTTGCAGATGAGGCTC | 80 | 1587 |
| 484302 | 32821 | 32840 | CAGCTCCATTTTGCAGATGA | 77 | 1588 |
| 484303 | 32878 | 32897 | AGAACAGTCTATCATCACTC | 34 | 1589 |
| 484304 | 32899 | 32918 | GAGGTGAGAGAGAAAGCAGA | 11 | 1590 |
| 484305 | 32904 | 32923 | CCCCTGAGGTGAGAGAGAAA | 46 | 1591 |
| 484306 | 32909 | 32928 | CCTGGCCCCTGAGGTGAGAG | 38 | 1592 |
| 484307 | 32914 | 32933 | TGGAGCCTGGCCCCTGAGGT | 12 | 1593 |
| 484308 | 32919 | 32938 | AACACTGGAGCCTGGCCCCT | 18 | 1594 |
| 484309 | 32924 | 32943 | CAGAGAACACTGGAGCCTGG | 35 | 1595 |
| 484310 | 32929 | 32948 | GGCAACAGAGAACACTGGAG | 62 | 1596 |
| 484311 | 32934 | 32953 | ACAGTGGCAACAGAGAACAC | 0 | 1597 |
| 484312 | 32940 | 32959 | CAGGCCACAGTGGCAACAGA | 3 | 1598 |
| 484313 | 32945 | 32964 | AGGACCAGGCCACAGTGGCA | 31 | 1599 |
| 484314 | 32950 | 32969 | TCCAGAGGACCAGGCCACAG | 22 | 1600 |
| 484315 | 32973 | 32992 | GGGCTACTGGCCTCCTGGAG | 47 | 1601 |
| 484316 | 33038 | 33057 | CAAAGGACACCTGCCTGTCC | 46 | 1602 |
| 484317 | 33043 | 33062 | GATAGCAAAGGACACCTGCC | 48 | 1603 |
| 484318 | 33065 | 33084 | TCTTTTGGAAGGGTGGAGAT | 16 | 1604 |
| 484319 | 33070 | 33089 | TTGGTTCTTTTGGAAGGGTG | 62 | 1605 |
| 484320 | 33096 | 33115 | GATGTGAGAAGGACACAGGG | 79 | 1606 |
| 484321 | 33101 | 33120 | ACAGAGATGTGAGAAGGACA | 77 | 1607 |
| 484322 | 33106 | 33125 | TTGGAACAGAGATGTGAGAA | 71 | 1608 |
| 484323 | 33111 | 33130 | ACTTCTTGGAACAGAGATGT | 69 | 1609 |
| 484324 | 33161 | 33180 | GCCCTCACAGGGCCAGGTTG | 77 | 1610 |
| 484325 | 33170 | 33189 | CCCCAGGGAGCCCTCACAGG | 68 | 1611 |
| 484326 | 33175 | 33194 | TAGTGCCCCAGGGAGCCCTC | 51 | 1612 |
| 484327 | 33180 | 33199 | TGTCCTAGTGCCCCAGGGAG | 86 | 1613 |
| 484328 | 33217 | 33236 | TCAACACCCCAGCCTGCCTC | 56 | 1614 |
| 484329 | 33222 | 33241 | GAGGCTCAACACCCCAGCCT | 47 | 1615 |
| 484330 | 33360 | 33379 | AGGAGGGTCACACACACCCC | 56 | 1616 |
| 484331 | 33388 | 33407 | GCAAGAGGCCAGGAAAAGGG | 53 | 1617 |
| 484332 | 33393 | 33412 | TACTGGCAAGAGGCCAGGAA | 53 | 1618 |
| 484333 | 33398 | 33417 | ATGATTACTGGCAAGAGGCC | 45 | 1619 |
| 484334 | 33403 | 33422 | ATTACATGATTACTGGCAAG | 30 | 1620 |

TABLE 26

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 413433 | 32431 | 32450 | GCCTGGACAAGTCCTGCCCA | 94 | 425 |
| 484335 | 35661 | 35680 | AAAATATACATGCTCTTTTT | 52 | 1621 |
| 484336 | 35666 | 35685 | ACTCAAAAATATACATGCTC | 88 | 1622 |
| 484337 | 35671 | 35690 | TTTCTACTCAAAAATATACA | 28 | 1623 |
| 484338 | 35676 | 35695 | TCCTTTTTCTACTCAAAAAT | 64 | 1624 |
| 484339 | 36215 | 36234 | TTCTGATTAGAAAAATAATA | 15 | 1625 |
| 484340 | 36220 | 36239 | TTTTATTCTGATTAGAAAAA | 33 | 1626 |
| 484341 | 36243 | 36262 | TATTCTGCTCATAAAAACAT | 44 | 1627 |
| 484342 | 36248 | 36267 | AAGGGTATTCTGCTCATAAA | 78 | 1628 |
| 484343 | 36253 | 36272 | TGAGTAAGGGTATTCTGCTC | 89 | 1629 |
| 484344 | 36258 | 36277 | GACAATGAGTAAGGGTATTC | 88 | 1630 |
| 484345 | 36263 | 36282 | AGAGAGACAATGAGTAAGGG | 46 | 1631 |
| 484346 | 36268 | 36287 | GGCTGAGAGAGACAATGAGT | 72 | 1632 |
| 484347 | 36318 | 36337 | AGCCTGTGACACCTACCCTG | 68 | 1633 |
| 484348 | 36354 | 36373 | ATGCAGTGTCCCTAAACCCT | 82 | 1634 |
| 484349 | 36359 | 36378 | GGGTGATGCAGTGTCCCTAA | 73 | 1635 |
| 484350 | 36409 | 36428 | TGGCTTCCTCAGGGCCCACC | 90 | 1636 |
| 484351 | 36454 | 36473 | CCTGACCTGTGGTACTAAGG | 68 | 1637 |
| 484352 | 36512 | 36531 | AGCCCTGTGCCAGCCAGCCT | 74 | 1638 |
| 484353 | 36517 | 36536 | GCGACAGCCCTGTGCCAGCC | 92 | 1639 |
| 484354 | 36522 | 36541 | GACAAGCGACAGCCCTGTGC | 60 | 1640 |
| 484355 | 36573 | 36592 | CCACAGTCAGCTGGGCTCAG | 72 | 1641 |
| 484356 | 36578 | 36597 | CTTTCCCACAGTCAGCTGGG | 70 | 1642 |
| 484357 | 36583 | 36602 | GGAAACTTTCCCACAGTCAG | 89 | 1643 |
| 484358 | 36588 | 36607 | CAAATGGAAACTTTCCCACA | 56 | 1644 |
| 484359 | 36617 | 36636 | GGCCTGGAAAAGGGACACTG | 71 | 1645 |
| 484360 | 36622 | 36641 | CCCCTGGCCTGGAAAAGGGA | 48 | 1646 |
| 484361 | 36627 | 36646 | CTACTCCCTGGCCTGGAAA | 21 | 1647 |
| 484362 | 36632 | 36651 | ACCTCCTACTCCCCTGGCCT | 67 | 1648 |
| 484363 | 36637 | 36656 | AGCCCACCTCCTACTCCCCT | 68 | 1649 |
| 484364 | 36642 | 36661 | CAGGCAGCCCACCTCCTACT | 66 | 1650 |
| 484365 | 36647 | 36666 | TGAGACAGGCAGCCCACCTC | 66 | 1651 |
| 484366 | 36652 | 36671 | CAGAATGAGACAGGCAGCCC | 56 | 1652 |
| 484367 | 36676 | 36695 | CTCTGTGGGCTCCTCCACAG | 45 | 1653 |
| 484368 | 36681 | 36700 | CTGTGCTCTGTGGGCTCCTC | 81 | 1654 |
| 484369 | 36686 | 36705 | TGGCCCTGTGCTCTGTGGGC | 42 | 1655 |

TABLE 26-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484370 | 36691 | 36710 | TTACTTGGCCCTGTGCTCTG | 75 | 1656 |
| 484371 | 36733 | 36752 | ACTGTCAGTCTCTCCAAACT | 73 | 1657 |
| 484372 | 36738 | 36757 | CCCCCACTGTCAGTCTCTCC | 78 | 1658 |
| 484373 | 36743 | 36762 | CTCTGCCCCCACTGTCAGTC | 72 | 1659 |
| 484374 | 36748 | 36767 | GCAAGCTCTGCCCCCACTGT | 71 | 1660 |
| 484375 | 36753 | 36772 | TGGCTGCAAGCTCTGCCCCC | 70 | 1661 |
| 484376 | 36758 | 36777 | GGCCTTGGCTGCAAGCTCTG | 76 | 1662 |
| 484377 | 36841 | 36860 | AATCCAACCCTTGTCACTCT | 88 | 1663 |
| 484378 | 36846 | 36865 | ACTCAAATCCAACCCTTGTC | 81 | 1664 |
| 484379 | 36855 | 36874 | TATTCTAAAACTCAAATCCA | 61 | 1665 |
| 484380 | 36860 | 36879 | GTGATTATTCTAAAACTCAA | 65 | 1666 |
| 484381 | 36865 | 36884 | CCAGAGTGATTATTCTAAAA | 73 | 1667 |
| 484382 | 36896 | 36915 | CCTCCCTCTGGGCCCATCCT | 74 | 1668 |
| 484383 | 36923 | 36942 | TTTGCACTCTGCCAGCCTCC | 78 | 1669 |
| 484384 | 36928 | 36947 | TCTTCTTTGCACTCTGCCAG | 69 | 1670 |
| 484385 | 36969 | 36988 | TGCCCTTGTTCCTCTCAGTC | 68 | 1671 |
| 484386 | 36974 | 36993 | ATGTTTGCCCTTGTTCCTCT | 62 | 1672 |
| 484387 | 37022 | 37041 | GTTGGGCAGTCACCATTTGC | 63 | 1673 |
| 484388 | 37027 | 37046 | CTGGTGTTGGGCAGTCACCA | 30 | 1674 |
| 484389 | 37032 | 37051 | CAGTGCTGGTGTTGGGCAGT | 30 | 1675 |
| 484390 | 37054 | 37073 | CAGACTCTCATCCCCAGGGC | 72 | 1676 |
| 484391 | 37119 | 37138 | GGATGTGTCATTTCCCCTGG | 86 | 1677 |
| 484392 | 37174 | 37193 | AGGAAACTGGCTGGGAGAGG | 20 | 1678 |
| 484393 | 37179 | 37198 | GTCAGAGGAAACTGGCTGGG | 48 | 1679 |
| 484394 | 37184 | 37203 | CTTGGGTCAGAGGAAACTGG | 37 | 1680 |
| 484395 | 37189 | 37208 | ATGACCTTGGGTCAGAGGAA | 38 | 1681 |
| 484396 | 37194 | 37213 | CAAGGATGACCTTGGGTCAG | 36 | 1682 |
| 484397 | 37199 | 37218 | AGCTGCAAGGATGACCTTGG | 48 | 1683 |
| 484398 | 37204 | 37223 | TCACCAGCTGCAAGGATGAC | 24 | 1684 |
| 484399 | 37440 | 37459 | AACAGTGCCCAGCAGGAGCA | 14 | 1685 |
| 484400 | 37445 | 37464 | TTGACAACAGTGCCCAGCAG | 19 | 1686 |
| 484401 | 37450 | 37469 | AGGCCTTGACAACAGTGCCC | 36 | 1687 |
| 484402 | 37455 | 37474 | GGCTCAGGCCTTGACAACAG | 57 | 1688 |
| 484403 | 37460 | 37479 | GGAGAGGCTCAGGCCTTGAC | 53 | 1689 |
| 484404 | 37485 | 37504 | GGCTCCCTGTGTCACCCTGC | 61 | 1690 |

TABLE 26-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484405 | 37490 | 37509 | GTGTTGGCTCCCTGTGTCAC | 39 | 1691 |
| 484406 | 37495 | 37514 | ATGGTGTGTTGGCTCCCTGT | 36 | 1692 |
| 484407 | 37500 | 37519 | AAGGAATGGTGTGTTGGCTC | 48 | 1693 |
| 484408 | 37505 | 37524 | GCACCAAGGAATGGTGTGTT | 30 | 1694 |
| 484409 | 37510 | 37529 | GCCCAGCACCAAGGAATGGT | 48 | 1695 |
| 484410 | 37515 | 37534 | TGCAGGCCCAGCACCAAGGA | 55 | 1696 |
| 484411 | 37520 | 37539 | CCCAATGCAGGCCCAGCACC | 67 | 1697 |

TABLE 27

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495425 | 10040 | 10059 | AGGGCCCTTTCCAGAAAATC | 84 | 1698 |
| 495426 | 10041 | 10060 | CAGGGCCCTTTCCAGAAAAT | 29 | 1699 |
| 495427 | 10042 | 10061 | ACAGGGCCCTTTCCAGAAAA | 14 | 1700 |
| 495428 | 10043 | 10062 | CACAGGGCCCTTTCCAGAAA | 64 | 1701 |
| 495429 | 10045 | 10064 | GCCACAGGGCCCTTTCCAGA | 86 | 1702 |
| 495430 | 10046 | 10065 | TGCCACAGGGCCCTTTCCAG | 77 | 1703 |
| 495431 | 10047 | 10066 | CTGCCACAGGGCCCTTTCCA | 50 | 1704 |
| 495432 | 10048 | 10067 | CCTGCCACAGGGCCCTTTCC | 44 | 1705 |
| 495433 | 10206 | 10225 | GAATATCCCTAATAACTAAG | 18 | 1706 |
| 495434 | 10207 | 10226 | CGAATATCCCTAATAACTAA | 8 | 1707 |
| 495435 | 10208 | 10227 | TCGAATATCCCTAATAACTA | 18 | 1708 |
| 495436 | 10209 | 10228 | CTCGAATATCCCTAATAACT | 66 | 1709 |
| 495437 | 10211 | 10230 | TTCTCGAATATCCCTAATAA | 31 | 1710 |
| 495438 | 10212 | 10231 | GTTCTCGAATATCCCTAATA | 69 | 1711 |
| 495439 | 10213 | 10232 | AGTTCTCGAATATCCCTAAT | 36 | 1712 |
| 495440 | 10214 | 10233 | GAGTTCTCGAATATCCCTAA | 84 | 1713 |
| 495441 | 10216 | 10235 | AGGAGTTCTCGAATATCCCT | 79 | 1714 |
| 495442 | 10217 | 10236 | GAGGAGTTCTCGAATATCCC | 83 | 1715 |
| 495443 | 10218 | 10237 | GGAGGAGTTCTCGAATATCC | 78 | 1716 |
| 495444 | 10219 | 10238 | GGGAGGAGTTCTCGAATATC | 64 | 1717 |
| 495445 | 10491 | 10510 | GCAGGGTCCTCTCCGCTGCC | 70 | 1718 |
| 495446 | 10492 | 10511 | TGCAGGGTCCTCTCCGCTGC | 80 | 1719 |

TABLE 27-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495447 | 10528 | 10547 | GATTCACTGAGGACCTCAGT | 71 | 1720 |
| 495448 | 10529 | 10548 | CGATTCACTGAGGACCTCAG | 78 | 1721 |
| 495449 | 10530 | 10549 | GCGATTCACTGAGGACCTCA | 94 | 1722 |
| 495450 | 10531 | 10550 | CGCGATTCACTGAGGACCTC | 90 | 1723 |
| 495451 | 10533 | 10552 | TGCGCGATTCACTGAGGACC | 82 | 1724 |
| 495452 | 10534 | 10553 | CTGCGCGATTCACTGAGGAC | 77 | 1725 |
| 495453 | 10535 | 10554 | TCTGCGCGATTCACTGAGGA | 81 | 1726 |
| 495454 | 10536 | 10555 | CTCTGCGCGATTCACTGAGG | 85 | 1727 |
| 495455 | 10646 | 10665 | CCTCCCACTTCAGTTTCTCC | 64 | 1728 |
| 495456 | 10647 | 10666 | TCCTCCCACTTCAGTTTCTC | 71 | 1729 |
| 495457 | 10648 | 10667 | TTCCTCCCACTTCAGTTTCT | 63 | 1730 |
| 495458 | 10649 | 10668 | CTTCCTCCCACTTCAGTTTC | 70 | 1731 |
| 495459 | 10651 | 10670 | TGCTTCCTCCCACTTCAGTT | 63 | 1732 |
| 495460 | 10652 | 10671 | ATGCTTCCTCCCACTTCAGT | 55 | 1733 |
| 495461 | 10653 | 10672 | CATGCTTCCTCCCACTTCAG | 70 | 1734 |
| 495462 | 10654 | 10673 | GCATGCTTCCTCCCACTTCA | 78 | 1735 |
| 495463 | 10656 | 10675 | AGGCATGCTTCCTCCCACTT | 81 | 1736 |
| 495464 | 10657 | 10676 | TAGGCATGCTTCCTCCCACT | 85 | 1737 |
| 495465 | 10658 | 10677 | TTAGGCATGCTTCCTCCCAC | 78 | 1738 |
| 495466 | 10659 | 10678 | CTTAGGCATGCTTCCTCCCA | 83 | 1739 |
| 495467 | 10661 | 10680 | AACTTAGGCATGCTTCCTCC | 82 | 1740 |
| 495468 | 10662 | 10681 | AAACTTAGGCATGCTTCCTC | 76 | 1741 |
| 495469 | 10663 | 10682 | AAAACTTAGGCATGCTTCCT | 83 | 1742 |
| 495470 | 10664 | 10683 | GAAAACTTAGGCATGCTTCC | 87 | 1743 |
| 495471 | 10666 | 10685 | AGGAAAACTTAGGCATGCTT | 83 | 1744 |
| 495472 | 10667 | 10686 | AAGGAAAACTTAGGCATGCT | 85 | 1745 |
| 495473 | 10668 | 10687 | TAAGGAAAACTTAGGCATGC | 76 | 1746 |
| 495474 | 10669 | 10688 | CTAAGGAAAACTTAGGCATG | 59 | 1747 |
| 495475 | 10671 | 10690 | AGCTAAGGAAAACTTAGGCA | 65 | 1748 |
| 495476 | 10672 | 10691 | CAGCTAAGGAAAACTTAGGC | 70 | 1749 |
| 495477 | 10673 | 10692 | TCAGCTAAGGAAAACTTAGG | 40 | 1750 |
| 495478 | 10674 | 10693 | ATCAGCTAAGGAAAACTTAG | 25 | 1751 |
| 495479 | 10728 | 10747 | TGTGATGACTTCCCAGGGTC | 75 | 1752 |
| 495480 | 10729 | 10748 | CTGTGATGACTTCCCAGGGT | 72 | 1753 |
| 495481 | 10730 | 10749 | GCTGTGATGACTTCCCAGGG | 87 | 1754 |

TABLE 27-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495482 | 10731 | 10750 | AGCTGTGATGACTTCCCAGG | 80 | 1755 |
| 495483 | 10733 | 10752 | ACAGCTGTGATGACTTCCCA | 79 | 1756 |
| 495484 | 10734 | 10753 | GACAGCTGTGATGACTTCCC | 86 | 1757 |
| 495485 | 10735 | 10754 | GGACAGCTGTGATGACTTCC | 80 | 1758 |
| 495486 | 10736 | 10755 | AGGACAGCTGTGATGACTTC | 62 | 1759 |
| 495487 | 10815 | 10834 | CATGTCAGAGAGGCTCAGCA | 72 | 1760 |
| 495488 | 10816 | 10835 | CCATGTCAGAGAGGCTCAGC | 87 | 1761 |
| 495489 | 10817 | 10836 | TCCATGTCAGAGAGGCTCAG | 86 | 1762 |
| 495490 | 10818 | 10837 | ATCCATGTCAGAGAGGCTCA | 88 | 1763 |
| 495491 | 10820 | 10839 | AAATCCATGTCAGAGAGGCT | 85 | 1764 |
| 495492 | 10821 | 10840 | AAAATCCATGTCAGAGAGGC | 86 | 1765 |
| 495493 | 10822 | 10841 | AAAAATCCATGTCAGAGAGG | 57 | 1766 |
| 495494 | 10823 | 10842 | GAAAAATCCATGTCAGAGAG | 52 | 1767 |
| 495495 | 10941 | 10960 | TGGATAGTCGATTTACCAGA | 92 | 1768 |
| 495496 | 10942 | 10961 | TTGGATAGTCGATTTACCAG | 89 | 1769 |
| 495497 | 10944 | 10963 | CTTTGGATAGTCGATTTACC | 89 | 1770 |
| 495498 | 11075 | 11094 | ACCTCGATGTTACATTAAGG | 90 | 1771 |
| 495499 | 11076 | 11095 | AACCTCGATGTTACATTAAG | 72 | 1772 |
| 495500 | 11077 | 11096 | AAACCTCGATGTTACATTAA | 64 | 1773 |
| 495501 | 11078 | 11097 | GAAACCTCGATGTTACATTA | 71 | 1774 |
| 413433 | 32431 | 32450 | GCCTGGACAAGTCCTGCCCA | 74 | 425 |

TABLE 28

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495502 | 11124 | 11143 | TATTGCAACCACTAGGACAT | 78 | 1775 |
| 495503 | 11125 | 11144 | TTATTGCAACCACTAGGACA | 72 | 1776 |
| 495504 | 11126 | 11145 | GTTATTGCAACCACTAGGAC | 79 | 1777 |
| 495505 | 11127 | 11146 | GGTTATTGCAACCACTAGGA | 91 | 1778 |
| 495506 | 11129 | 11148 | TGGGTTATTGCAACCACTAG | 91 | 1779 |
| 495507 | 11130 | 11149 | GTGGGTTATTGCAACCACTA | 86 | 1780 |
| 495508 | 11131 | 11150 | GGTGGGTTATTGCAACCACT | 85 | 1781 |
| 495509 | 11159 | 11178 | TCACAGTTAAAGTGTGGTAC | 82 | 1782 |

TABLE 28-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495510 | 11160 | 11179 | GTCACAGTTAAAGTGTGGTA | 84 | 1783 |
| 495511 | 11161 | 11180 | GGTCACAGTTAAAGTGTGGT | 78 | 1784 |
| 495512 | 11162 | 11181 | AGGTCACAGTTAAAGTGTGG | 7 | 1785 |
| 495513 | 11169 | 11188 | AATGCCTAGGTCACAGTTAA | 46 | 1786 |
| 495514 | 11170 | 11189 | CAATGCCTAGGTCACAGTTA | 80 | 1787 |
| 495515 | 11171 | 11190 | CCAATGCCTAGGTCACAGTT | 88 | 1788 |
| 495516 | 11172 | 11191 | GCCAATGCCTAGGTCACAGT | 94 | 1789 |
| 495517 | 11174 | 11193 | ATGCCAATGCCTAGGTCACA | 92 | 1790 |
| 495518 | 11175 | 11194 | AATGCCAATGCCTAGGTCAC | 93 | 1791 |
| 495519 | 11176 | 11195 | CAATGCCAATGCCTAGGTCA | 92 | 1792 |
| 495520 | 11177 | 11196 | GCAATGCCAATGCCTAGGTC | 92 | 1793 |
| 495521 | 11200 | 11219 | CCACAGCGATAATCACACAA | 84 | 1794 |
| 495522 | 11201 | 11220 | ACCACAGCGATAATCACACA | 92 | 1795 |
| 495523 | 11202 | 11221 | AACCACAGCGATAATCACAC | 94 | 1796 |
| 495524 | 11203 | 11222 | TAACCACAGCGATAATCACA | 91 | 1797 |
| 495525 | 14504 | 14523 | GCAGGGTCTGCCACTCTCTA | 86 | 1798 |
| 495526 | 14505 | 14524 | AGCAGGGTCTGCCACTCTCT | 92 | 1799 |
| 495527 | 14506 | 14525 | GAGCAGGGTCTGCCACTCTC | 91 | 1800 |
| 495528 | 14507 | 14526 | AGAGCAGGGTCTGCCACTCT | 82 | 1801 |
| 495529 | 14649 | 14668 | GCACAGTCATCTTGTGTACA | 86 | 1802 |
| 495530 | 14650 | 14669 | TGCACAGTCATCTTGTGTAC | 81 | 1803 |
| 495531 | 14651 | 14670 | CTGCACAGTCATCTTGTGTA | 80 | 1804 |
| 495532 | 14652 | 14671 | TCTGCACAGTCATCTTGTGT | 64 | 1805 |
| 495533 | 14659 | 14678 | AGATCACTCTGCACAGTCAT | 81 | 1806 |
| 495534 | 14660 | 14679 | CAGATCACTCTGCACAGTCA | 87 | 1807 |
| 495535 | 14661 | 14680 | TCAGATCACTCTGCACAGTC | 90 | 1808 |
| 495536 | 14662 | 14681 | CTCAGATCACTCTGCACAGT | 86 | 1809 |
| 495537 | 14664 | 14683 | TGCTCAGATCACTCTGCACA | 87 | 1810 |
| 495538 | 14665 | 14684 | TTGCTCAGATCACTCTGCAC | 78 | 1811 |
| 495539 | 14666 | 14685 | ATTGCTCAGATCACTCTGCA | 84 | 1812 |
| 495540 | 14667 | 14686 | CATTGCTCAGATCACTCTGC | 88 | 1813 |
| 495541 | 14741 | 14760 | CCTCTTCCAGGAAGACTTCC | 80 | 1814 |
| 495542 | 14742 | 14761 | ACCTCTTCCAGGAAGACTTC | 72 | 1815 |
| 495543 | 14743 | 14762 | CACCTCTTCCAGGAAGACTT | 88 | 1816 |
| 495544 | 14744 | 14763 | TCACCTCTTCCAGGAAGACT | 86 | 1817 |

TABLE 28-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495545 | 14746 | 14765 | TGTCACCTCTTCCAGGAAGA | 82 | 1818 |
| 495546 | 14747 | 14766 | ATGTCACCTCTTCCAGGAAG | 42 | 1819 |
| 495547 | 14748 | 14767 | AATGTCACCTCTTCCAGGAA | 50 | 1820 |
| 495548 | 14749 | 14768 | GAATGTCACCTCTTCCAGGA | 74 | 1821 |
| 495549 | 14751 | 14770 | CTGAATGTCACCTCTTCCAG | 75 | 1822 |
| 495550 | 14752 | 14771 | ACTGAATGTCACCTCTTCCA | 81 | 1823 |
| 495551 | 14753 | 14772 | GACTGAATGTCACCTCTTCC | 81 | 1824 |
| 495552 | 14754 | 14773 | GGACTGAATGTCACCTCTTC | 88 | 1825 |
| 495553 | 14756 | 14775 | CCGGACTGAATGTCACCTCT | 90 | 1826 |
| 495554 | 14757 | 14776 | TCCGGACTGAATGTCACCTC | 91 | 1827 |
| 495555 | 14758 | 14777 | ATCCGGACTGAATGTCACCT | 91 | 1828 |
| 495556 | 14759 | 14778 | GATCCGGACTGAATGTCACC | 85 | 1829 |
| 495557 | 14766 | 14785 | CTTTCCAGATCCGGACTGAA | 67 | 1830 |
| 495558 | 14767 | 14786 | TCTTTCCAGATCCGGACTGA | 77 | 1831 |
| 495559 | 14768 | 14787 | ATCTTTCCAGATCCGGACTG | 69 | 1832 |
| 495560 | 14769 | 14788 | CATCTTTCCAGATCCGGACT | 88 | 1833 |
| 495561 | 14771 | 14790 | TTCATCTTTCCAGATCCGGA | 89 | 1834 |
| 495562 | 14772 | 14791 | ATTCATCTTTCCAGATCCGG | 94 | 1835 |
| 495563 | 14773 | 14792 | TATTCATCTTTCCAGATCCG | 92 | 1836 |
| 495564 | 14774 | 14793 | CTATTCATCTTTCCAGATCC | 84 | 1837 |
| 495565 | 14992 | 15011 | CTCAAGTCTTCCTCCTGCTG | 79 | 1838 |
| 495566 | 14993 | 15012 | TCTCAAGTCTTCCTCCTGCT | 83 | 1839 |
| 495567 | 14994 | 15013 | CTCTCAAGTCTTCCTCCTGC | 63 | 1840 |
| 495568 | 14995 | 15014 | GCTCTCAAGTCTTCCTCCTG | 86 | 1841 |
| 495569 | 14997 | 15016 | GAGCTCTCAAGTCTTCCTCC | 84 | 1842 |
| 495570 | 14998 | 15017 | TGAGCTCTCAAGTCTTCCTC | 90 | 1843 |
| 495571 | 14999 | 15018 | ATGAGCTCTCAAGTCTTCCT | 91 | 1844 |
| 495572 | 15000 | 15019 | CATGAGCTCTCAAGTCTTCC | 85 | 1845 |
| 495573 | 15248 | 15267 | CATAATCTGCACAGGTTCTT | 84 | 1846 |
| 495574 | 15249 | 15268 | CCATAATCTGCACAGGTTCT | 87 | 1847 |
| 495575 | 15250 | 15269 | ACCATAATCTGCACAGGTTC | 91 | 1848 |
| 495576 | 15251 | 15270 | CACCATAATCTGCACAGGTT | 94 | 1849 |
| 495577 | 15253 | 15272 | TGCACCATAATCTGCACAGG | 90 | 1850 |
| 495578 | 15254 | 15273 | CTGCACCATAATCTGCACAG | 86 | 1851 |
| 413433 | 32431 | 32450 | GCCTGGACAAGTCCTGCCCA | 92 | 425 |

TABLE 29

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495579 | 15255 | 15274 | TCTGCACCATAATCTGCACA | 78 | 1852 |
| 495580 | 15256 | 15275 | ATCTGCACCATAATCTGCAC | 73 | 1853 |
| 495581 | 18152 | 18171 | TAATCCAGGATTGTCATAAG | 53 | 1854 |
| 495582 | 18153 | 18172 | TTAATCCAGGATTGTCATAA | 54 | 1855 |
| 495583 | 18154 | 18173 | TTTAATCCAGGATTGTCATA | 40 | 1856 |
| 495584 | 18155 | 18174 | CTTTAATCCAGGATTGTCAT | 70 | 1857 |
| 495585 | 18157 | 18176 | AGCTTTAATCCAGGATTGTC | 81 | 1858 |
| 495586 | 18158 | 18177 | TAGCTTTAATCCAGGATTGT | 37 | 1859 |
| 495587 | 18159 | 18178 | TTAGCTTTAATCCAGGATTG | 60 | 1860 |
| 495588 | 18160 | 18179 | CTTAGCTTTAATCCAGGATT | 75 | 1861 |
| 495589 | 18162 | 18181 | TCCTTAGCTTTAATCCAGGA | 78 | 1862 |
| 495590 | 18163 | 18182 | CTCCTTAGCTTTAATCCAGG | 77 | 1863 |
| 495591 | 18164 | 18183 | CCTCCTTAGCTTTAATCCAG | 82 | 1864 |
| 495592 | 18165 | 18184 | TCCTCCTTAGCTTTAATCCA | 73 | 1865 |
| 495593 | 18167 | 18186 | TGTCCTCCTTAGCTTTAATC | 69 | 1866 |
| 495594 | 18168 | 18187 | GTGTCCTCCTTAGCTTTAAT | 61 | 1867 |
| 495595 | 18169 | 18188 | AGTGTCCTCCTTAGCTTTAA | 51 | 1868 |
| 495596 | 18170 | 18189 | CAGTGTCCTCCTTAGCTTTA | 61 | 1869 |
| 495597 | 18172 | 18191 | CTCAGTGTCCTCCTTAGCTT | 76 | 1870 |
| 495598 | 18173 | 18192 | ACTCAGTGTCCTCCTTAGCT | 81 | 1871 |
| 495599 | 18174 | 18193 | GACTCAGTGTCCTCCTTAGC | 83 | 1872 |
| 495600 | 18175 | 18194 | GGACTCAGTGTCCTCCTTAG | 80 | 1873 |
| 495601 | 18177 | 18196 | TGGGACTCAGTGTCCTCCTT | 64 | 1874 |
| 495602 | 18178 | 18197 | CTGGGACTCAGTGTCCTCCT | 72 | 1875 |
| 495603 | 18179 | 18198 | CCTGGGACTCAGTGTCCTCC | 77 | 1876 |
| 495604 | 18180 | 18199 | CCCTGGGACTCAGTGTCCTC | 88 | 1877 |
| 495605 | 18307 | 18326 | TCCTGTTTGATGGGTAAAAT | 77 | 1878 |
| 495606 | 18308 | 18327 | CTCCTGTTTGATGGGTAAAA | 83 | 1879 |
| 495607 | 18309 | 18328 | TCTCCTGTTTGATGGGTAAA | 78 | 1880 |
| 495608 | 18310 | 18329 | CTCTCCTGTTTGATGGGTAA | 81 | 1881 |
| 495609 | 18312 | 18331 | TCCTCTCCTGTTTGATGGGT | 83 | 1882 |
| 495610 | 18313 | 18332 | GTCCTCTCCTGTTTGATGGG | 77 | 1883 |
| 495611 | 18314 | 18333 | TGTCCTCTCCTGTTTGATGG | 69 | 1884 |
| 495612 | 18315 | 18334 | GTGTCCTCTCCTGTTTGATG | 76 | 1885 |
| 495613 | 18317 | 18336 | CGGTGTCCTCTCCTGTTTGA | 77 | 1886 |
| 495614 | 18318 | 18337 | TCGGTGTCCTCTCCTGTTTG | 72 | 1887 |

TABLE 29-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495615 | 18319 | 18338 | CTCGGTGTCCTCTCCTGTTT | 69 | 1888 |
| 495616 | 18320 | 18339 | CCTCGGTGTCCTCTCCTGTT | 77 | 1889 |
| 495617 | 18322 | 18341 | AGCCTCGGTGTCCTCTCCTG | 72 | 1890 |
| 495618 | 18323 | 18342 | AAGCCTCGGTGTCCTCTCCT | 84 | 1891 |
| 495619 | 18324 | 18343 | TAAGCCTCGGTGTCCTCTCC | 88 | 1892 |
| 495620 | 18325 | 18344 | GTAAGCCTCGGTGTCCTCTC | 91 | 1893 |
| 495621 | 18327 | 18346 | AAGTAAGCCTCGGTGTCCTC | 86 | 1894 |
| 495622 | 18328 | 18347 | CAAGTAAGCCTCGGTGTCCT | 81 | 1895 |
| 495623 | 18330 | 18349 | ACCAAGTAAGCCTCGGTGTC | 79 | 1896 |
| 495624 | 18418 | 18437 | CTCACCAGATTGTTGTGGGA | 79 | 1897 |
| 495625 | 18419 | 18438 | CCTCACCAGATTGTTGTGGG | 77 | 1898 |
| 495626 | 18420 | 18439 | ACCTCACCAGATTGTTGTGG | 79 | 1899 |
| 495627 | 18421 | 18440 | TACCTCACCAGATTGTTGTG | 47 | 1900 |
| 495628 | 18428 | 18447 | TAATACCTACCTCACCAGAT | 56 | 1901 |
| 495629 | 18429 | 18448 | CTAATACCTACCTCACCAGA | 49 | 1902 |
| 495630 | 18430 | 18449 | GCTAATACCTACCTCACCAG | 60 | 1903 |
| 495631 | 18431 | 18450 | GGCTAATACCTACCTCACCA | 70 | 1904 |
| 495632 | 18451 | 18470 | CTTCCTCATCTATACAGTGG | 72 | 1905 |
| 495633 | 18452 | 18471 | GCTTCCTCATCTATACAGTG | 72 | 1906 |
| 495634 | 18453 | 18472 | AGCTTCCTCATCTATACAGT | 63 | 1907 |
| 495635 | 18454 | 18473 | CAGCTTCCTCATCTATACAG | 66 | 1908 |
| 495636 | 18582 | 18601 | CCATACTGGCATCTGGCAGG | 78 | 1909 |
| 495637 | 18583 | 18602 | TCCATACTGGCATCTGGCAG | 73 | 1910 |
| 495638 | 18584 | 18603 | CTCCATACTGGCATCTGGCA | 78 | 1911 |
| 495639 | 18585 | 18604 | CCTCCATACTGGCATCTGGC | 82 | 1912 |
| 495640 | 18587 | 18606 | CACCTCCATACTGGCATCTG | 51 | 1913 |
| 495641 | 18588 | 18607 | TCACCTCCATACTGGCATCT | 71 | 1914 |
| 495642 | 18589 | 18608 | CTCACCTCCATACTGGCATC | 72 | 1915 |
| 495643 | 18590 | 18609 | CCTCACCTCCATACTGGCAT | 70 | 1916 |
| 495644 | 18592 | 18611 | CACCTCACCTCCATACTGGC | 68 | 1917 |
| 495645 | 18593 | 18612 | CCACCTCACCTCCATACTGG | 54 | 1918 |
| 495646 | 18594 | 18613 | CCCACCTCACCTCCATACTG | 45 | 1919 |
| 495647 | 18595 | 18614 | ACCCACCTCACCTCCATACT | 37 | 1920 |
| 495648 | 18827 | 18846 | GGATGCTTAACTTCTGCTGA | 67 | 1921 |
| 495649 | 18828 | 18847 | AGGATGCTTAACTTCTGCTG | 83 | 1922 |

TABLE 29-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495650 | 18829 | 18848 | TAGGATGCTTAACTTCTGCT | 84 | 1923 |
| 495651 | 18830 | 18849 | TTAGGATGCTTAACTTCTGC | 68 | 1924 |
| 495652 | 18832 | 18851 | AGTTAGGATGCTTAACTTCT | 50 | 1925 |
| 495653 | 18833 | 18852 | AAGTTAGGATGCTTAACTTC | 49 | 1926 |
| 495654 | 18834 | 18853 | TAAGTTAGGATGCTTAACTT | 49 | 1927 |
| 495655 | 18835 | 18854 | TTAAGTTAGGATGCTTAACT | 42 | 1928 |
| 413433 | 32431 | 32450 | GCCTGGACAAGTCCTGCCCA | 82 | 425 |

TABLE 30

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 423461 | 32429 | 32448 | CTGGACAAGTCCTGCCCATC | 73 | 465 |
| 423462 | 32430 | 32449 | CCTGGACAAGTCCTGCCCAT | 70 | 466 |
| 413433 | 32431 | 32450 | GCCTGGACAAGTCCTGCCCA | 87 | 425 |
| 495656 | 18870 20780 | 18889 20799 | TATAGGCCTGGATGCCCAAG | 70 | 1929 |
| 495657 | 18871 20781 | 18890 20800 | CTATAGGCCTGGATGCCCAA | 72 | 1930 |
| 495658 | 18896 | 18915 | AGATGATGTCCTGCCTCAGA | 30 | 1931 |
| 495659 | 18897 | 18916 | CAGATGATGTCCTGCCTCAG | 37 | 1932 |
| 495660 | 18898 | 18917 | GCAGATGATGTCCTGCCTCA | 65 | 1933 |
| 495661 | 18899 | 18918 | AGCAGATGATGTCCTGCCTC | 72 | 1934 |
| 495662 | 19014 | 19033 | AGTCAAAGGTGGCTTCCTGG | 67 | 1935 |
| 495663 | 19015 | 19034 | TAGTCAAAGGTGGCTTCCTG | 57 | 1936 |
| 495664 | 19016 | 19035 | GTAGTCAAAGGTGGCTTCCT | 75 | 1937 |
| 495665 | 19017 | 19036 | AGTAGTCAAAGGTGGCTTCC | 66 | 1938 |
| 495666 | 19020 | 19039 | ATGAGTAGTCAAAGGTGGCT | 73 | 1939 |
| 495667 | 19021 | 19040 | AATGAGTAGTCAAAGGTGGC | 64 | 1940 |
| 495668 | 19022 | 19041 | GAATGAGTAGTCAAAGGTGG | 31 | 1941 |
| 495669 | 20775 | 20794 | GCCTGGATGCCCAAGTTAGA | 72 | 1942 |
| 495670 | 20776 | 20795 | GGCCTGGATGCCCAAGTTAG | 73 | 1943 |
| 495671 | 20777 | 20796 | AGGCCTGGATGCCCAAGTTA | 77 | 1944 |
| 495672 | 20778 | 20797 | TAGGCCTGGATGCCCAAGTT | 57 | 1945 |
| 495673 | 22544 | 22563 | ACAAGTGGGAAATGCAGTCT | 48 | 1946 |

TABLE 30-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495674 | 22545 | 22564 | AACAAGTGGGAAATGCAGTC | 42 | 1947 |
| 495675 | 22546 | 22565 | CAACAAGTGGGAAATGCAGT | 35 | 1948 |
| 495676 | 22547 | 22566 | CCAACAAGTGGGAAATGCAG | 62 | 1949 |
| 495677 | 22549 | 22568 | TGCCAACAAGTGGGAAATGC | 70 | 1950 |
| 495678 | 22550 | 22569 | CTGCCAACAAGTGGGAAATG | 52 | 1951 |
| 495679 | 22551 | 22570 | TCTGCCAACAAGTGGGAAAT | 39 | 1952 |
| 495680 | 22552 | 22571 | CTCTGCCAACAAGTGGGAAA | 34 | 1953 |
| 495681 | 22767 | 22786 | GCTTATTAGGTGTCTTAAAA | 51 | 1954 |
| 495682 | 22768 | 22787 | AGCTTATTAGGTGTCTTAAA | 56 | 1955 |
| 495683 | 22769 | 22788 | AAGCTTATTAGGTGTCTTAA | 59 | 1956 |
| 495684 | 22770 | 22789 | TAAGCTTATTAGGTGTCTTA | 63 | 1957 |
| 495685 | 22772 | 22791 | GCTAAGCTTATTAGGTGTCT | 86 | 1958 |
| 495686 | 22773 | 22792 | TGCTAAGCTTATTAGGTGTC | 80 | 1959 |
| 495687 | 22774 | 22793 | CTGCTAAGCTTATTAGGTGT | 68 | 1960 |
| 495688 | 22775 | 22794 | TCTGCTAAGCTTATTAGGTG | 64 | 1961 |
| 495689 | 22882 | 22901 | CCCCATGCAGCTTGGAGGAG | 60 | 1962 |
| 495690 | 22883 | 22902 | CCCCCATGCAGCTTGGAGGA | 53 | 1963 |
| 495691 | 22884 | 22903 | GCCCCCATGCAGCTTGGAGG | 43 | 1964 |
| 495692 | 22885 | 22904 | AGCCCCCATGCAGCTTGGAG | 61 | 1965 |
| 495693 | 22887 | 22906 | CCAGCCCCCATGCAGCTTGG | 66 | 1966 |
| 495694 | 22888 | 22907 | GCCAGCCCCCATGCAGCTTG | 78 | 1967 |
| 495695 | 22889 | 22908 | GGCCAGCCCCCATGCAGCTT | 71 | 1968 |
| 495696 | 22890 | 22909 | GGGCCAGCCCCCATGCAGCT | 63 | 1969 |
| 495697 | 23096 | 23115 | AGTCCAAACACTCAGGTAGG | 82 | 1970 |
| 495698 | 23097 | 23116 | CAGTCCAAACACTCAGGTAG | 68 | 1971 |
| 495699 | 23098 | 23117 | TCAGTCCAAACACTCAGGTA | 74 | 1972 |
| 495700 | 23099 | 23118 | TTCAGTCCAAACACTCAGGT | 72 | 1973 |
| 495701 | 23238 | 23257 | GGGAACAGCAGCATCAGCAT | 77 | 1974 |
| 495702 | 23239 | 23258 | TGGGAACAGCAGCATCAGCA | 83 | 1975 |
| 495703 | 23240 | 23259 | CTGGGAACAGCAGCATCAGC | 68 | 1976 |
| 495704 | 23241 | 23260 | TCTGGGAACAGCAGCATCAG | 65 | 1977 |
| 495705 | 23243 | 23262 | GGTCTGGGAACAGCAGCATC | 84 | 1978 |
| 495706 | 23244 | 23263 | TGGTCTGGGAACAGCAGCAT | 81 | 1979 |
| 495707 | 23245 | 23264 | GTGGTCTGGGAACAGCAGCA | 84 | 1980 |
| 495708 | 23423 | 23442 | CAAGTCATCTTCCAGCAGCT | 57 | 1981 |

TABLE 30-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495709 | 23424 | 23443 | ACAAGTCATCTTCCAGCAGC | 36 | 1982 |
| 495710 | 23425 | 23444 | GACAAGTCATCTTCCAGCAG | 38 | 1983 |
| 495711 | 23426 | 23445 | GGACAAGTCATCTTCCAGCA | 77 | 1984 |
| 495712 | 23428 | 23447 | CTGGACAAGTCATCTTCCAG | 53 | 1985 |
| 495713 | 23429 | 23448 | GCTGGACAAGTCATCTTCCA | 66 | 1986 |
| 495714 | 23430 | 23449 | GGCTGGACAAGTCATCTTCC | 76 | 1987 |
| 495715 | 23431 | 23450 | GGGCTGGACAAGTCATCTTC | 45 | 1988 |
| 495716 | 23548 | 23567 | ATCCTTGAGGGTCTCATAAC | 58 | 1989 |
| 495717 | 23549 | 23568 | TATCCTTGAGGGTCTCATAA | 61 | 1990 |
| 495718 | 23551 | 23570 | CTTATCCTTGAGGGTCTCAT | 83 | 1991 |
| 495719 | 23553 | 23572 | TGCTTATCCTTGAGGGTCTC | 79 | 1992 |
| 495720 | 23554 | 23573 | ATGCTTATCCTTGAGGGTCT | 73 | 1993 |
| 495721 | 23555 | 23574 | CATGCTTATCCTTGAGGGTC | 64 | 1994 |
| 495722 | 23556 | 23575 | ACATGCTTATCCTTGAGGGT | 60 | 1995 |
| 495723 | 26396 | 26415 | CTGGATGGCAACCTAAGGAG | 61 | 1996 |
| 495724 | 26397 | 26416 | CCTGGATGGCAACCTAAGGA | 74 | 1997 |
| 495725 | 26398 | 26417 | GCCTGGATGGCAACCTAAGG | 61 | 1998 |
| 495726 | 26399 | 26418 | GGCCTGGATGGCAACCTAAG | 60 | 1999 |
| 495727 | 26401 | 26420 | CTGGCCTGGATGGCAACCTA | 69 | 2000 |
| 495728 | 26480 | 26499 | TGCTATGCTGAGAGCACAGG | 69 | 2001 |
| 495729 | 26481 | 26500 | CTGCTATGCTGAGAGCACAG | 64 | 2002 |
| 495730 | 26482 | 26501 | CCTGCTATGCTGAGAGCACA | 81 | 2003 |

TABLE 31

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495731 | 26483 | 26502 | ACCTGCTATGCTGAGAGCAC | 75 | 2004 |
| 495732 | 26485 | 26504 | CTACCTGCTATGCTGAGAGC | 69 | 2005 |
| 495733 | 26486 | 26505 | GCTACCTGCTATGCTGAGAG | 54 | 2006 |
| 495734 | 26487 | 26506 | AGCTACCTGCTATGCTGAGA | 67 | 2007 |
| 495735 | 26488 | 26507 | AAGCTACCTGCTATGCTGAG | 44 | 2008 |
| 495736 | 26517 | 26536 | GCAGGTTCATCTGCCTTGAC | 88 | 2009 |
| 495737 | 26518 | 26537 | AGCAGGTTCATCTGCCTTGA | 75 | 2010 |

TABLE 31-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495738 | 26519 | 26538 | GAGCAGGTTCATCTGCCTTG | 84 | 2011 |
| 495739 | 26520 | 26539 | GGAGCAGGTTCATCTGCCTT | 80 | 2012 |
| 495740 | 26532 | 26551 | CTGTGATGCTCTGGAGCAGG | 56 | 2013 |
| 495741 | 26533 | 26552 | TCTGTGATGCTCTGGAGCAG | 49 | 2014 |
| 495742 | 26534 | 26553 | CTCTGTGATGCTCTGGAGCA | 66 | 2015 |
| 495743 | 26535 | 26554 | ACTCTGTGATGCTCTGGAGC | 74 | 2016 |
| 495744 | 26537 | 26556 | GCACTCTGTGATGCTCTGGA | 85 | 2017 |
| 495745 | 26538 | 26557 | TGCACTCTGTGATGCTCTGG | 80 | 2018 |
| 495746 | 26539 | 26558 | ATGCACTCTGTGATGCTCTG | 70 | 2019 |
| 495747 | 26540 | 26559 | AATGCACTCTGTGATGCTCT | 60 | 2020 |
| 495748 | 26626 | 26645 | TGACATGGTAAGTCCTGATG | 79 | 2021 |
| 495749 | 26627 | 26646 | CTGACATGGTAAGTCCTGAT | 86 | 2022 |
| 495750 | 26628 | 26647 | ACTGACATGGTAAGTCCTGA | 79 | 2023 |
| 495751 | 26629 | 26648 | CACTGACATGGTAAGTCCTG | 84 | 2024 |
| 495752 | 26631 | 26650 | AGCACTGACATGGTAAGTCC | 90 | 2025 |
| 495753 | 26632 | 26651 | CAGCACTGACATGGTAAGTC | 86 | 2026 |
| 495754 | 26633 | 26652 | TCAGCACTGACATGGTAAGT | 73 | 2027 |
| 495755 | 26634 | 26653 | CTCAGCACTGACATGGTAAG | 63 | 2028 |
| 495756 | 26779 | 26798 | CTGCCATTTAATGAGCTTCA | 86 | 2029 |
| 495757 | 26780 | 26799 | TCTGCCATTTAATGAGCTTC | 77 | 2030 |
| 495758 | 26781 | 26800 | CTCTGCCATTTAATGAGCTT | 50 | 2031 |
| 495759 | 26782 | 26801 | ACTCTGCCATTTAATGAGCT | 43 | 2032 |
| 495760 | 26784 | 26803 | CAACTCTGCCATTTAATGAG | 34 | 2033 |
| 495761 | 26785 | 26804 | CCAACTCTGCCATTTAATGA | 39 | 2034 |
| 495762 | 26786 | 26805 | CCCAACTCTGCCATTTAATG | 74 | 2035 |
| 495763 | 26787 | 26806 | TCCCAACTCTGCCATTTAAT | 76 | 2036 |
| 495764 | 26789 | 26808 | AATCCCAACTCTGCCATTTA | 62 | 2037 |
| 495765 | 26790 | 26809 | AAATCCCAACTCTGCCATTT | 61 | 2038 |
| 495766 | 26927 | 26946 | TTTAAGGGTTCATGGATCCC | 70 | 2039 |
| 495767 | 26928 | 26947 | TTTTAAGGGTTCATGGATCC | 48 | 2040 |
| 495768 | 26929 | 26948 | ATTTTAAGGGTTCATGGATC | 23 | 2041 |
| 495769 | 26930 | 26949 | AATTTTAAGGGTTCATGGAT | 9 | 2042 |
| 495770 | 27247 | 27266 | TGGAGTCCCTGGGTTCTTGT | 51 | 2043 |
| 495771 | 27248 | 27267 | CTGGAGTCCCTGGGTTCTTG | 52 | 2044 |
| 495772 | 27249 | 27268 | GCTGGAGTCCCTGGGTTCTT | 72 | 2045 |

TABLE 31-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495773 | 27250 | 27269 | GGCTGGAGTCCCTGGGTTCT | 64 | 2046 |
| 495774 | 27252 | 27271 | GAGGCTGGAGTCCCTGGGTT | 64 | 2047 |
| 495775 | 27253 | 27272 | GGAGGCTGGAGTCCCTGGGT | 45 | 2048 |
| 495776 | 27255 | 27274 | TGGGAGGCTGGAGTCCCTGG | 24 | 2049 |
| 495777 | 27353 | 27372 | TACCAGCCAGGCCCAGACCC | 8 | 2050 |
| 495778 | 27354 | 27373 | CTACCAGCCAGGCCCAGACC | 7 | 2051 |
| 495779 | 27355 | 27374 | CCTACCAGCCAGGCCCAGAC | 6 | 2052 |
| 495780 | 27356 | 27375 | CCCTACCAGCCAGGCCCAGA | 9 | 2053 |
| 495781 | 27378 | 27397 | GTGTTCTACAAGCTGCTCAG | 64 | 2054 |
| 495782 | 27379 | 27398 | GGTGTTCTACAAGCTGCTCA | 77 | 2055 |
| 495783 | 27380 | 27399 | TGGTGTTCTACAAGCTGCTC | 68 | 2056 |
| 495784 | 27381 | 27400 | CTGGTGTTCTACAAGCTGCT | 74 | 2057 |
| 495785 | 27383 | 27402 | AGCTGGTGTTCTACAAGCTG | 80 | 2058 |
| 495786 | 27384 | 27403 | GAGCTGGTGTTCTACAAGCT | 61 | 2059 |
| 495787 | 27385 | 27404 | TGAGCTGGTGTTCTACAAGC | 58 | 2060 |
| 495788 | 27386 | 27405 | GTGAGCTGGTGTTCTACAAG | 62 | 2061 |
| 495789 | 27438 | 27457 | GTCTGATCAATTATTAACCT | 71 | 2062 |
| 495790 | 27439 | 27458 | GGTCTGATCAATTATTAACC | 57 | 2063 |
| 495791 | 27440 | 27459 | GGGTCTGATCAATTATTAAC | 60 | 2064 |
| 495792 | 27441 | 27460 | TGGGTCTGATCAATTATTAA | 40 | 2065 |
| 495793 | 29674 | 29693 | CAGGTACTCATGTTTGGTGG | 63 | 2066 |
| 495794 | 29675 | 29694 | GCAGGTACTCATGTTTGGTG | 75 | 2067 |
| 495795 | 29676 | 29695 | AGCAGGTACTCATGTTTGGT | 73 | 2068 |
| 495796 | 29677 | 29696 | CAGCAGGTACTCATGTTTGG | 66 | 2069 |
| 495797 | 29679 | 29698 | GGCAGCAGGTACTCATGTTT | 60 | 2070 |
| 495798 | 29680 | 29699 | GGGCAGCAGGTACTCATGTT | 58 | 2071 |
| 495799 | 29681 | 29700 | AGGGCAGCAGGTACTCATGT | 63 | 2072 |
| 495800 | 29682 | 29701 | AAGGGCAGCAGGTACTCATG | 75 | 2073 |
| 495801 | 29778 | 29797 | CAATATCATACTATCTACAT | 11 | 2074 |
| 495802 | 29779 | 29798 | CCAATATCATACTATCTACA | 13 | 2075 |
| 495803 | 29780 | 29799 | CCCAATATCATACTATCTAC | 51 | 2076 |
| 495804 | 29781 | 29800 | CCCCAATATCATACTATCTA | 71 | 2077 |
| 495805 | 29783 | 29802 | TTCCCCAATATCATACTATC | 50 | 2078 |
| 495806 | 29825 | 29844 | AACCTTTAAGGCCTATCTCA | 32 | 2079 |

TABLE 31-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495807 | 29826 | 29845 | CAACCTTTAAGGCCTATCTC | 25 | 2080 |
| 413433 | 32431 | 32450 | GCCTGGACAAGTCCTGCCCA | 84 | 425 |

TABLE 32

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495808 | 29827 | 29846 | CCAACCTTTAAGGCCTATCT | 82 | 2081 |
| 495809 | 29828 | 29847 | CCCAACCTTTAAGGCCTATC | 90 | 2082 |
| 495810 | 29830 | 29849 | TACCCAACCTTTAAGGCCTA | 82 | 2083 |
| 495811 | 29831 | 29850 | TTACCCAACCTTTAAGGCCT | 75 | 2084 |
| 495812 | 29832 | 29851 | TTTACCCAACCTTTAAGGCC | 73 | 2085 |
| 495813 | 29833 | 29852 | TTTTACCCAACCTTTAAGGC | 70 | 2086 |
| 495814 | 29835 | 29854 | TTTTTTACCCAACCTTTAAG | 32 | 2087 |
| 495815 | 29836 | 29855 | ATTTTTTACCCAACCTTTAA | 27 | 2088 |
| 495816 | 29837 | 29856 | CATTTTTTACCCAACCTTTA | 54 | 2089 |
| 495817 | 29838 | 29857 | CCATTTTTTACCCAACCTTT | 81 | 2090 |
| 495818 | 29840 | 29859 | TTCCATTTTTTACCCAACCT | 89 | 2091 |
| 495819 | 29841 | 29860 | TTTCCATTTTTTACCCAACC | 88 | 2092 |
| 495820 | 29842 | 29861 | CTTTCCATTTTTTACCCAAC | 85 | 2093 |
| 495821 | 29843 | 29862 | TCTTTCCATTTTTTACCCAA | 74 | 2094 |
| 495822 | 30484 | 30503 | TTAGGCTTTAGAAATTCACC | 85 | 2095 |
| 495823 | 30485 | 30504 | ATTAGGCTTTAGAAATTCAC | 69 | 2096 |
| 413433 | 32431 | 32450 | GCCTGGACAAGTCCTGCCCA | 89 | 425 |
| 495824 | 32437 | 32456 | TATGCAGCCTGGACAAGTCC | 65 | 2097 |
| 495825 | 32447 | 32466 | CATACTAGACTATGCAGCCT | 91 | 2098 |
| 495826 | 32448 | 32467 | TCATACTAGACTATGCAGCC | 88 | 2099 |
| 495827 | 32449 | 32468 | ATCATACTAGACTATGCAGC | 86 | 2100 |
| 495828 | 32450 | 32469 | CATCATACTAGACTATGCAG | 82 | 2101 |
| 495829 | 32452 | 32471 | GCCATCATACTAGACTATGC | 92 | 2102 |
| 495830 | 32453 | 32472 | TGCCATCATACTAGACTATG | 81 | 2103 |
| 495831 | 32454 | 32473 | TTGCCATCATACTAGACTAT | 82 | 2104 |
| 495832 | 32455 | 32474 | GTTGCCATCATACTAGACTA | 88 | 2105 |
| 495833 | 32457 | 32476 | ATGTTGCCATCATACTAGAC | 78 | 2106 |

TABLE 32-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495834 | 32458 | 32477 | AATGTTGCCATCATACTAGA | 68 | 2107 |
| 495835 | 32459 | 32478 | CAATGTTGCCATCATACTAG | 85 | 2108 |
| 495836 | 32460 | 32479 | GCAATGTTGCCATCATACTA | 91 | 2109 |
| 495837 | 32462 | 32481 | TTGCAATGTTGCCATCATAC | 95 | 2110 |
| 495838 | 32463 | 32482 | GTTGCAATGTTGCCATCATA | 86 | 2111 |
| 495839 | 32464 | 32483 | GGTTGCAATGTTGCCATCAT | 94 | 2112 |
| 495840 | 32465 | 32484 | TGGTTGCAATGTTGCCATCA | 94 | 2113 |
| 495841 | 32467 | 32486 | GGTGGTTGCAATGTTGCCAT | 91 | 2114 |
| 495842 | 32468 | 32487 | TGGTGGTTGCAATGTTGCCA | 92 | 2115 |
| 495843 | 32469 | 32488 | ATGGTGGTTGCAATGTTGCC | 84 | 2116 |
| 495844 | 32470 | 32489 | GATGGTGGTTGCAATGTTGC | 82 | 2117 |
| 495845 | 32472 | 32491 | TGGATGGTGGTTGCAATGTT | 51 | 2118 |
| 495846 | 32473 | 32492 | CTGGATGGTGGTTGCAATGT | 48 | 2119 |
| 495847 | 32474 | 32493 | CCTGGATGGTGGTTGCAATG | 64 | 2120 |
| 495848 | 32475 | 32494 | GCCTGGATGGTGGTTGCAAT | 76 | 2121 |
| 495849 | 32477 | 32496 | AAGCCTGGATGGTGGTTGCA | 89 | 2122 |
| 495850 | 32478 | 32497 | TAAGCCTGGATGGTGGTTGC | 71 | 2123 |
| 495851 | 32479 | 32498 | ATAAGCCTGGATGGTGGTTG | 69 | 2124 |
| 495852 | 32480 | 32499 | AATAAGCCTGGATGGTGGTT | 85 | 2125 |
| 495853 | 32620 | 32639 | AACTGAGATCTCCAGCAGCA | 93 | 2126 |
| 495854 | 32621 | 32640 | AAACTGAGATCTCCAGCAGC | 82 | 2127 |
| 495855 | 32622 | 32641 | TAAACTGAGATCTCCAGCAG | 79 | 2128 |
| 495856 | 32623 | 32642 | TTAAACTGAGATCTCCAGCA | 81 | 2129 |
| 495857 | 32753 | 32772 | GACAAAGTCTATCAGGATGC | 90 | 2130 |
| 495858 | 32754 | 32773 | TGACAAAGTCTATCAGGATG | 67 | 2131 |
| 495859 | 32755 | 32774 | GTGACAAAGTCTATCAGGAT | 73 | 2132 |
| 495860 | 32756 | 32775 | AGTGACAAAGTCTATCAGGA | 72 | 2133 |
| 495861 | 32758 | 32777 | AAAGTGACAAAGTCTATCAG | 58 | 2134 |
| 495862 | 32759 | 32778 | GAAAGTGACAAAGTCTATCA | 67 | 2135 |
| 495863 | 32760 | 32779 | AGAAAGTGACAAAGTCTATC | 63 | 2136 |
| 495864 | 33176 | 33195 | CTAGTGCCCCAGGGAGCCCT | 63 | 2137 |
| 495865 | 33177 | 33196 | CCTAGTGCCCCAGGGAGCCC | 67 | 2138 |
| 495866 | 33178 | 33197 | TCCTAGTGCCCCAGGGAGCC | 60 | 2139 |
| 495867 | 33179 | 33198 | GTCCTAGTGCCCCAGGGAGC | 83 | 2140 |
| 495868 | 33181 | 33200 | TTGTCCTAGTGCCCCAGGGA | 87 | 2141 |
| 495869 | 33182 | 33201 | TTTGTCCTAGTGCCCCAGGG | 82 | 2142 |

TABLE 32-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495870 | 33183 | 33202 | TTTTGTCCTAGTGCCCCAGG | 66 | 2143 |
| 495871 | 36244 | 36263 | GTATTCTGCTCATAAAAACA | 42 | 2144 |
| 495872 | 36245 | 36264 | GGTATTCTGCTCATAAAAAC | 56 | 2145 |
| 495873 | 36246 | 36265 | GGGTATTCTGCTCATAAAAA | 72 | 2146 |
| 495874 | 36247 | 36266 | AGGGTATTCTGCTCATAAAA | 82 | 2147 |
| 495875 | 36249 | 36268 | TAAGGGTATTCTGCTCATAA | 89 | 2148 |
| 495876 | 36250 | 36269 | GTAAGGGTATTCTGCTCATA | 90 | 2149 |
| 495877 | 36251 | 36270 | AGTAAGGGTATTCTGCTCAT | 85 | 2150 |
| 495878 | 36252 | 36271 | GAGTAAGGGTATTCTGCTCA | 94 | 2151 |
| 495879 | 36259 | 36278 | AGACAATGAGTAAGGGTATT | 67 | 2152 |
| 495880 | 36260 | 36279 | GAGACAATGAGTAAGGGTAT | 47 | 2153 |
| 495881 | 36261 | 36280 | AGAGACAATGAGTAAGGGTA | 60 | 2154 |
| 495882 | 36262 | 36281 | GAGAGACAATGAGTAAGGGT | 77 | 2155 |
| 495883 | 36264 | 36283 | GAGAGAGACAATGAGTAAGG | 64 | 2156 |
| 495884 | 36265 | 36284 | TGAGAGAGACAATGAGTAAG | 31 | 2157 |

TABLE 33

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 413433 | 32431 | 32450 | GCCTGGACAAGTCCTGCCCA | 87 | 425 |
| 495885 | 36266 | 36285 | CTGAGAGAGACAATGAGTAA | 51 | 2158 |
| 495886 | 36518 | 36537 | AGCGACAGCCCTGTGCCAGC | 67 | 2159 |
| 495887 | 36519 | 36538 | AAGCGACAGCCCTGTGCCAG | 43 | 2160 |
| 495888 | 36520 | 36539 | CAAGCGACAGCCCTGTGCCA | 15 | 2161 |
| 495889 | 36521 | 36540 | ACAAGCGACAGCCCTGTGCC | 25 | 2162 |
| 495890 | 36523 | 36542 | GGACAAGCGACAGCCCTGTG | 44 | 2163 |
| 495891 | 36524 | 36543 | AGGACAAGCGACAGCCCTGT | 42 | 2164 |
| 495892 | 36648 | 36667 | ATGAGACAGGCAGCCCACCT | 53 | 2165 |
| 495893 | 36649 | 36668 | AATGAGACAGGCAGCCCACC | 56 | 2166 |
| 495894 | 36650 | 36669 | GAATGAGACAGGCAGCCCAC | 46 | 2167 |
| 495895 | 36651 | 36670 | AGAATGAGACAGGCAGCCCA | 56 | 2168 |
| 495896 | 36653 | 36672 | ACAGAATGAGACAGGCAGCC | 42 | 2169 |
| 495897 | 36654 | 36673 | CACAGAATGAGACAGGCAGC | 47 | 2170 |

TABLE 33-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495898 | 36655 | 36674 | TCACAGAATGAGACAGGCAG | 24 | 2171 |
| 495899 | 36677 | 36696 | GCTCTGTGGGCTCCTCCACA | 72 | 2172 |
| 495900 | 36678 | 36697 | TGCTCTGTGGGCTCCTCCAC | 70 | 2173 |
| 495901 | 36679 | 36698 | GTGCTCTGTGGGCTCCTCCA | 76 | 2174 |
| 495902 | 36680 | 36699 | TGTGCTCTGTGGGCTCCTCC | 81 | 2175 |
| 495903 | 36682 | 36701 | CCTGTGCTCTGTGGGCTCCT | 65 | 2176 |
| 495904 | 36683 | 36702 | CCCTGTGCTCTGTGGGCTCC | 70 | 2177 |
| 495905 | 36684 | 36703 | GCCCTGTGCTCTGTGGGCTC | 31 | 2178 |
| 495906 | 36685 | 36704 | GGCCCTGTGCTCTGTGGGCT | 32 | 2179 |
| 495907 | 36687 | 36706 | TTGGCCCTGTGCTCTGTGGG | 46 | 2180 |
| 495908 | 36688 | 36707 | CTTGGCCCTGTGCTCTGTGG | 41 | 2181 |
| 495909 | 36689 | 36708 | ACTTGGCCCTGTGCTCTGTG | 66 | 2182 |
| 495910 | 36690 | 36709 | TACTTGGCCCTGTGCTCTGT | 52 | 2183 |
| 495911 | 36734 | 36753 | CACTGTCAGTCTCTCCAAAC | 75 | 2184 |
| 495912 | 36735 | 36754 | CCACTGTCAGTCTCTCCAAA | 75 | 2185 |
| 495913 | 36736 | 36755 | CCCACTGTCAGTCTCTCCAA | 60 | 2186 |
| 495914 | 36737 | 36756 | CCCCACTGTCAGTCTCTCCA | 63 | 2187 |
| 495915 | 36739 | 36758 | GCCCCACTGTCAGTCTCTC | 48 | 2188 |
| 495916 | 36740 | 36759 | TGCCCCACTGTCAGTCTCT | 46 | 2189 |
| 495917 | 36741 | 36760 | CTGCCCCACTGTCAGTCTC | 55 | 2190 |
| 495918 | 36742 | 36761 | TCTGCCCCACTGTCAGTCT | 68 | 2191 |
| 495919 | 36754 | 36773 | TTGGCTGCAAGCTCTGCCCC | 59 | 2192 |
| 495920 | 36755 | 36774 | CTTGGCTGCAAGCTCTGCCC | 63 | 2193 |
| 495921 | 36756 | 36775 | CCTTGGCTGCAAGCTCTGCC | 65 | 2194 |
| 495922 | 36757 | 36776 | GCCTTGGCTGCAAGCTCTGC | 65 | 2195 |
| 495923 | 36759 | 36778 | GGGCCTTGGCTGCAAGCTCT | 65 | 2196 |
| 495924 | 36856 | 36875 | TTATTCTAAAACTCAAATCC | 8 | 2197 |
| 495925 | 36857 | 36876 | ATTATTCTAAAACTCAAATC | 11 | 2198 |
| 495926 | 36859 | 36878 | TGATTATTCTAAAACTCAAA | 2 | 2199 |
| 495927 | 36861 | 36880 | AGTGATTATTCTAAAACTCA | 55 | 2200 |
| 495928 | 36862 | 36881 | GAGTGATTATTCTAAAACTC | 36 | 2201 |
| 495929 | 36863 | 36882 | AGAGTGATTATTCTAAAACT | 0 | 2202 |
| 495930 | 36864 | 36883 | CAGAGTGATTATTCTAAAAC | 28 | 2203 |
| 495931 | 37023 | 37042 | TGTTGGGCAGTCACCATTTG | 1 | 2204 |
| 495932 | 37024 | 37043 | GTGTTGGGCAGTCACCATTT | 17 | 2205 |
| 495933 | 37025 | 37044 | GGTGTTGGGCAGTCACCATT | 20 | 2206 |

TABLE 33-continued

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495934 | 37026 | 37045 | TGGTGTTGGGCAGTCACCAT | 2 | 2207 |
| 495935 | 37185 | 37204 | CCTTGGGTCAGAGGAAACTG | 5 | 2208 |
| 495936 | 37186 | 37205 | ACCTTGGGTCAGAGGAAACT | 12 | 2209 |
| 495937 | 37187 | 37206 | GACCTTGGGTCAGAGGAAAC | 15 | 2210 |
| 495938 | 37188 | 37207 | TGACCTTGGGTCAGAGGAAA | 2 | 2211 |
| 495939 | 37190 | 37209 | GATGACCTTGGGTCAGAGGA | 18 | 2212 |
| 495940 | 37191 | 37210 | GGATGACCTTGGGTCAGAGG | 16 | 2213 |
| 495941 | 37192 | 37211 | AGGATGACCTTGGGTCAGAG | 13 | 2214 |
| 495942 | 37193 | 37212 | AAGGATGACCTTGGGTCAGA | 8 | 2215 |
| 495943 | 37195 | 37214 | GCAAGGATGACCTTGGGTCA | 26 | 2216 |
| 495944 | 37196 | 37215 | TGCAAGGATGACCTTGGGTC | 24 | 2217 |
| 495945 | 37197 | 37216 | CTGCAAGGATGACCTTGGGT | 32 | 2218 |
| 495946 | 37198 | 37217 | GCTGCAAGGATGACCTTGGG | 16 | 2219 |
| 495947 | 37200 | 37219 | CAGCTGCAAGGATGACCTTG | 7 | 2220 |
| 495948 | 37201 | 37220 | CCAGCTGCAAGGATGACCTT | 0 | 2221 |
| 495949 | 37203 | 37222 | CACCAGCTGCAAGGATGACC | 27 | 2222 |
| 495950 | 37491 | 37510 | TGTGTTGGCTCCCTGTGTCA | 38 | 2223 |
| 495951 | 37492 | 37511 | GTGTGTTGGCTCCCTGTGTC | 11 | 2224 |
| 495952 | 37493 | 37512 | GGTGTGTTGGCTCCCTGTGT | 40 | 2225 |
| 495953 | 37494 | 37513 | TGGTGTGTTGGCTCCCTGTG | 29 | 2226 |
| 495954 | 37496 | 37515 | AATGGTGTGTTGGCTCCCTG | 49 | 2227 |
| 495955 | 37497 | 37516 | GAATGGTGTGTTGGCTCCCT | 76 | 2228 |
| 495956 | 37498 | 37517 | GGAATGGTGTGTTGGCTCCC | 44 | 2229 |
| 495957 | 37499 | 37518 | AGGAATGGTGTGTTGGCTCC | 72 | 2230 |
| 495958 | 37501 | 37520 | CAAGGAATGGTGTGTTGGCT | 74 | 2231 |
| 495959 | 37502 | 37521 | CCAAGGAATGGTGTGTTGGC | 8 | 2232 |
| 495960 | 37503 | 37522 | ACCAAGGAATGGTGTGTTGG | 21 | 2233 |
| 495961 | 37504 | 37523 | CACCAAGGAATGGTGTGTTG | 18 | 2234 |

TABLE 34

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 423460 | 32428 | 32447 | TGGACAAGTCCTGCCCATCT | 65 | 464 |
| 423461 | 32429 | 32448 | CTGGACAAGTCCTGCCCATC | 70 | 465 |

TABLE 34-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 423462 | 32430 | 32449 | CCTGGACAAGTCCTGCCCAT | 54 | 466 |
| 413433 | 32431 | 32450 | GCCTGGACAAGTCCTGCCCA | 80 | 425 |
| 495962 | 37506 | 37525 | AGCACCAAGGAATGGTGTGT | 6 | 2235 |
| 495963 | 37507 | 37526 | CAGCACCAAGGAATGGTGTG | 19 | 2236 |
| 495964 | 37508 | 37527 | CCAGCACCAAGGAATGGTGT | 13 | 2237 |
| 495965 | 37509 | 37528 | CCCAGCACCAAGGAATGGTG | 26 | 2238 |
| 495966 | 37511 | 37530 | GGCCCAGCACCAAGGAATGG | 14 | 2239 |
| 495967 | 37512 | 37531 | AGGCCCAGCACCAAGGAATG | 4 | 2240 |
| 495968 | 37513 | 37532 | CAGGCCCAGCACCAAGGAAT | 8 | 2241 |
| 495969 | 37514 | 37533 | GCAGGCCCAGCACCAAGGAA | 33 | 2242 |
| 495970 | 37516 | 37535 | ATGCAGGCCCAGCACCAAGG | 33 | 2243 |
| 495971 | 37517 | 37536 | AATGCAGGCCCAGCACCAAG | 14 | 2244 |
| 495972 | 37518 | 37537 | CAATGCAGGCCCAGCACCAA | 16 | 2245 |
| 495973 | 37519 | 37538 | CCAATGCAGGCCCAGCACCA | 45 | 2246 |
| 495974 | 40192 | 40211 | CTGAACTTCCCCTCCCAAAC | 16 | 2247 |
| 495975 | 40197 | 40216 | CAAATCTGAACTTCCCCTCC | 0 | 2248 |
| 495976 | 40202 | 40221 | AAATGCAAATCTGAACTTCC | 30 | 2249 |
| 495977 | 40223 | 40242 | GCAGCTCCAAGGATCATTTT | 44 | 2250 |
| 495978 | 40228 | 40247 | ATCCAGCAGCTCCAAGGATC | 45 | 2251 |
| 495979 | 40233 | 40252 | CTTCCATCCAGCAGCTCCAA | 51 | 2252 |
| 495980 | 40238 | 40257 | CCCATCTTCCATCCAGCAGC | 49 | 2253 |
| 495981 | 40243 | 40262 | TCTAACCCATCTTCCATCCA | 28 | 2254 |
| 495982 | 40248 | 40267 | ATTTTTCTAACCCATCTTCC | 21 | 2255 |
| 495983 | 40253 | 40272 | CTTCCATTTTTCTAACCCAT | 64 | 2256 |
| 495984 | 40293 | 40312 | GCCACTGGCTACCAAAACAG | 37 | 2257 |
| 495985 | 40298 | 40317 | TCCAAGCCACTGGCTACCAA | 41 | 2258 |
| 495986 | 40303 | 40322 | CTTGGTCCAAGCCACTGGCT | 43 | 2259 |
| 495987 | 40308 | 40327 | ACTCCCTTGGTCCAAGCCAC | 44 | 2260 |
| 495988 | 40313 | 40332 | CTGCTACTCCCTTGGTCCAA | 40 | 2261 |
| 495989 | 40318 | 40337 | CTCCACTGCTACTCCCTTGG | 11 | 2262 |
| 495990 | 40323 | 40342 | TCCATCTCCACTGCTACTCC | 39 | 2263 |
| 495991 | 40328 | 40347 | TCTCTTCCATCTCCACTGCT | 36 | 2264 |
| 495992 | 40333 | 40352 | GCACATCTCTTCCATCTCCA | 82 | 2265 |
| 495993 | 40338 | 40357 | ATCATGCACATCTCTTCCAT | 39 | 2266 |
| 495994 | 40359 | 40378 | TATTTCTGAAATTTTCCCA | 17 | 2267 |
| 495995 | 40364 | 40383 | AATGCTATTTCTGAAATTTT | 10 | 2268 |

TABLE 34-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495996 | 40386 | 40405 | CAATCCATTCCTATGTCCTG | 24 | 2269 |
| 495997 | 40391 | 40410 | ATACCCAATCCATTCCTATG | 13 | 2270 |
| 495998 | 40396 | 40415 | TCTCCATACCCAATCCATTC | 45 | 2271 |
| 495999 | 40401 | 40420 | CTGCATCTCCATACCCAATC | 59 | 2272 |
| 496000 | 40406 | 40425 | TCCTGCTGCATCTCCATACC | 38 | 2273 |
| 496001 | 40411 | 40430 | TCTTATCCTGCTGCATCTCC | 15 | 2274 |
| 496002 | 40416 | 40435 | TATTTTCTTATCCTGCTGCA | 46 | 2275 |
| 496003 | 40421 | 40440 | TGCTTTATTTTCTTATCCTG | 47 | 2276 |
| 496004 | 40444 | 40463 | ACCAGCATTTATGATCTGTG | 67 | 2277 |
| 496005 | 40807 | 40826 | GACATGCTTTAAAAAGTGTA | 25 | 2278 |
| 496006 | 40812 | 40831 | AATGTGACATGCTTTAAAAA | 23 | 2279 |
| 496007 | 40899 | 40918 | AGCCATTCCTGCCTCTCTGA | 12 | 2280 |
| 496008 | 40904 | 40923 | GGGCAAGCCATTCCTGCCTC | 5 | 2281 |
| 496009 | 40909 | 40928 | GCTCTGGGCAAGCCATTCCT | 60 | 2282 |
| 496010 | 40914 | 40933 | GCTCTGCTCTGGGCAAGCCA | 66 | 2283 |
| 496011 | 40919 | 40938 | CTTTTGCTCTGCTCTGGGCA | 50 | 2284 |
| 496012 | 40924 | 40943 | CTTTGCTTTTGCTCTGCTCT | 67 | 2285 |
| 496013 | 40929 | 40948 | AACATCTTTGCTTTTGCTCT | 59 | 2286 |
| 496014 | 40934 | 40953 | AAGTAAACATCTTTGCTTTT | 15 | 2287 |
| 496015 | 40939 | 40958 | GGATCAAGTAAACATCTTTG | 42 | 2288 |
| 496016 | 40967 | 40986 | TCTGCTAGGAGGGTCTATGA | 20 | 2289 |
| 496017 | 40972 | 40991 | TGCATTCTGCTAGGAGGGTC | 39 | 2290 |
| 496018 | 40977 | 40996 | CCCACTGCATTCTGCTAGGA | 27 | 2291 |
| 496019 | 40982 | 41001 | TTGAACCCACTGCATTCTGC | 6 | 2292 |
| 496020 | 40987 | 41006 | ACTGGTTGAACCCACTGCAT | 0 | 2293 |
| 496021 | 40992 | 41011 | TCAAGACTGGTTGAACCCAC | 8 | 2294 |
| 496022 | 40997 | 41016 | TGGGATCAAGACTGGTTGAA | 0 | 2295 |
| 496023 | 41002 | 41021 | GCAGATGGGATCAAGACTGG | 0 | 2296 |
| 496024 | 41007 | 41026 | AAGCTGCAGATGGGATCAAG | 0 | 2297 |
| 496025 | 41012 | 41031 | GTGCTAAGCTGCAGATGGGA | 39 | 2298 |
| 496026 | 41043 | 41062 | GCATGTGAAGGGACCCACCC | 14 | 2299 |
| 496027 | 41064 | 41083 | TGAAAAGACTGAGGCCCAGG | 1 | 2300 |
| 496028 | 41069 | 41088 | ACAGATGAAAAGACTGAGGC | 21 | 2301 |
| 496029 | 41074 | 41093 | CTATTACAGATGAAAAGACT | 0 | 2302 |
| 496030 | 41079 | 41098 | GTCCCTATTACAGATGAAA | 34 | 2303 |
| 496031 | 41084 | 41103 | TGGTTGTCCCCTATTACAGA | 39 | 2304 |

TABLE 34-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 496032 | 41089 | 41108 | ATCTCTGGTTGTCCCCTATT | 21 | 2305 |
| 496033 | 41094 | 41113 | GCTGCATCTCTGGTTGTCCC | 65 | 2306 |
| 496034 | 41099 | 41118 | TATGTGCTGCATCTCTGGTT | 51 | 2307 |
| 496035 | 42398 | 42417 | TCTCACTTTCATTTATTTTC | 70 | 2308 |

TABLE 35

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501381 | 24794 | 24813 | GCTTCAGGCAGCCTGAAGGA | 46 | 2309 |
| 501382 | 24799 | 24818 | AGTGAGCTTCAGGCAGCCTG | 75 | 2310 |
| 501383 | 24823 | 24842 | GCTTCCCCAAAGGGCCCAGT | 70 | 2311 |
| 501384 | 24828 | 24847 | CCTTTGCTTCCCCAAAGGGC | 71 | 2312 |
| 501385 | 24878 | 24897 | CCTCATCTCAGTGCCCAAAG | 90 | 2313 |
| 501386 | 25018 | 25037 | AGCATCCCCAATCCCTGCTC | 65 | 2314 |
| 501387 | 25023 | 25042 | CTTTGAGCATCCCCAATCCC | 91 | 2315 |
| 501388 | 25028 | 25047 | GTGTACTTTGAGCATCCCCA | 82 | 2316 |
| 501389 | 25033 | 25052 | TCCAAGTGTACTTTGAGCAT | 85 | 2317 |
| 501390 | 25069 | 25088 | AGAGGTTCAACATCCAATTT | 81 | 2318 |
| 501391 | 25075 | 25094 | AAGGACAGAGGTTCAACATC | 88 | 2319 |
| 501392 | 25080 | 25099 | AGGCCAAGGACAGAGGTTCA | 82 | 2320 |
| 501393 | 25085 | 25104 | CTGTGAGGCCAAGGACAGAG | 88 | 2321 |
| 501394 | 25090 | 25109 | TCTGTCTGTGAGGCCAAGGA | 77 | 2322 |
| 501395 | 25095 | 25114 | TGCTATCTGTCTGTGAGGCC | 77 | 2323 |
| 501396 | 25183 | 25202 | GTCTCTCATAATTGCCAGTT | 82 | 2324 |
| 501397 | 25188 | 25207 | GGGAAGTCTCTCATAATTGC | 67 | 2325 |
| 501398 | 25193 | 25212 | GCCTTGGGAAGTCTCTCATA | 85 | 2326 |
| 501399 | 25198 | 25217 | GCTAGGCCTTGGGAAGTCTC | 76 | 2327 |
| 501400 | 25226 | 25245 | TGAAGTATCTAAAGAGGCTA | 71 | 2328 |
| 501401 | 25231 | 25250 | CCACATGAAGTATCTAAAGA | 74 | 2329 |
| 501402 | 25236 | 25255 | GGAGACCACATGAAGTATCT | 75 | 2330 |
| 501403 | 25241 | 25260 | ATTTTGGAGACCACATGAAG | 68 | 2331 |
| 501404 | 25246 | 25265 | GGGTCATTTTGGAGACCACA | 91 | 2332 |
| 501405 | 25267 | 25286 | ATGGGAATGGTATCGCACTC | 85 | 2333 |

TABLE 35-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501406 | 25272 | 25291 | ACACAATGGGAATGGTATCG | 80 | 2334 |
| 501407 | 25297 | 25316 | CCCCTGTGCCCTGGTTTCTA | 49 | 2335 |
| 501408 | 25302 | 25321 | ATGCTCCCTGTGCCCTGGT | 44 | 2336 |
| 501409 | 25307 | 25326 | TCTGCATGCTCCCTGTGCC | 44 | 2337 |
| 501410 | 25312 | 25331 | GGCTGTCTGCATGCTCCCT | 76 | 2338 |
| 501411 | 25375 | 25394 | CTATAGAATCAGACAGACCT | 83 | 2339 |
| 501412 | 25380 | 25399 | ATCAGCTATAGAATCAGACA | 90 | 2340 |
| 501413 | 25424 | 25443 | CAAACCTCACCTCCCACAGG | 33 | 2341 |
| 501414 | 25429 | 25448 | CAGTACAAACCTCACCTCCC | 70 | 2342 |
| 501415 | 25468 | 25487 | TCAGTCCACTGTCACCCTTC | 33 | 2343 |
| 501416 | 25473 | 25492 | AGATGTCAGTCCACTGTCAC | 13 | 2344 |
| 501417 | 25478 | 25497 | AGGGAAGATGTCAGTCCACT | 0 | 2345 |
| 501418 | 25483 | 25502 | AGCAGAGGGAAGATGTCAGT | 0 | 2346 |
| 501419 | 25489 | 25508 | GCCTACAGCAGAGGGAAGAT | 29 | 2347 |
| 501420 | 25494 | 25513 | CCAGTGCCTACAGCAGAGGG | 38 | 2348 |
| 501421 | 25499 | 25518 | TGGATCCAGTGCCTACAGCA | 41 | 2349 |
| 501422 | 25505 | 25524 | GGATGCTGGATCCAGTGCCT | 74 | 2350 |
| 501423 | 25618 | 25637 | ACCCAGTACAAGGAAGGACA | 78 | 2351 |
| 501424 | 25623 | 25642 | AGCTTACCCAGTACAAGGAA | 31 | 2352 |
| 501425 | 25628 | 25647 | GGCCCAGCTTACCCAGTACA | 48 | 2353 |
| 501426 | 25717 | 25736 | CTCTTATTCCCTCACCCCTG | 77 | 2354 |
| 501427 | 25782 | 25801 | CACTTGATCTGGGACCCAAA | 96 | 2355 |
| 501428 | 25787 | 25806 | TAGAGCACTTGATCTGGGAC | 80 | 2356 |
| 501429 | 25841 | 25860 | ACTATCACACCACCTCCCAC | 85 | 2357 |
| 501430 | 25846 | 25865 | TGGGAACTATCACACCACCT | 95 | 2358 |
| 501431 | 25851 | 25870 | GTAAATGGGAACTATCACAC | 64 | 2359 |
| 501432 | 25856 | 25875 | CATCTGTAAATGGGAACTAT | 49 | 2360 |
| 501433 | 25861 | 25880 | TTTCCCATCTGTAAATGGGA | 0 | 2361 |
| 501434 | 25866 | 25885 | TGAGGTTTCCCATCTGTAAA | 61 | 2362 |
| 501435 | 25900 | 25919 | GACCTTGGGCAAGTTACCTA | 88 | 2363 |
| 501436 | 25905 | 25924 | TGTGTGACCTTGGGCAAGTT | 82 | 2364 |
| 501437 | 25910 | 25929 | AAATCTGTGTGACCTTGGGC | 67 | 2365 |
| 501438 | 25915 | 25934 | GATTCAAATCTGTGTGACCT | 89 | 2366 |
| 501439 | 25920 | 25939 | ACAGGGATTCAAATCTGTGT | 73 | 2367 |
| 501440 | 25950 | 25969 | GGAAAGGCACAGGCTTTGGG | 88 | 2368 |
| 501441 | 25981 | 26000 | AATGTCTGTTGGTGGGCAGG | 77 | 2369 |

TABLE 35-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501442 | 26005 | 26024 | GGCAAAGTAACATACCTGCT | 94 | 2370 |
| 501443 | 26010 | 26029 | CTTAAGGCAAAGTAACATAC | 91 | 2371 |
| 501444 | 26069 | 26088 | TGTAAGGTCACAGAGCTTGT | 54 | 2372 |
| 501445 | 26102 | 26121 | GGAAACTAACACTCAGAGAG | 70 | 2373 |
| 501446 | 26107 | 26126 | AATGAGGAAACTAACACTCA | 62 | 2374 |
| 501447 | 26165 | 26184 | TTTCTTATCTTCAATCCTCA | 95 | 2375 |
| 501448 | 26170 | 26189 | TCTCATTTCTTATCTTCAAT | 92 | 2376 |
| 501449 | 26175 | 26194 | GGTGCTCTCATTTCTTATCT | 81 | 2377 |
| 501450 | 26200 | 26219 | CCCATCATGACCAGGCCCTG | 91 | 2378 |
| 501451 | 26300 | 26319 | AGGCCTCGGGAAGCACCTGG | 89 | 2379 |
| 501452 | 26305 | 26324 | GGAGCAGGCCTCGGGAAGCA | 90 | 2380 |
| 501453 | 26331 | 26350 | ATGTGGGCTGTGCTGAGAGA | 64 | 2381 |
| 501454 | 26353 | 26372 | AGAAAAAGCAACCAAAGCAC | 89 | 2382 |
| 501455 | 26358 | 26377 | CCTGCAGAAAAAGCAACCAA | 81 | 2383 |
| 501456 | 26363 | 26382 | CCAGACCTGCAGAAAAAGCA | 76 | 2384 |
| 501457 | 26385 | 26404 | CCTAAGGAGTGAGGGTATCT | 79 | 2385 |
| 413433 | 32431 | 32450 | GCCTGGACAAGTCCTGCCCA | 48 | 425 |

TABLE 36

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501303 | 23656 | 23675 | CTCTGAGTGCAAAGGCTCTG | 40 | 2386 |
| 501304 | 23661 | 23680 | AGCAGCTCTGAGTGCAAAGG | 48 | 2387 |
| 501305 | 23666 | 23685 | CCCAGAGCAGCTCTGAGTGC | 45 | 2388 |
| 501306 | 23671 | 23690 | CTTTCCCCAGAGCAGCTCTG | 25 | 2389 |
| 501307 | 23694 | 23713 | TGACCCTGCTTAGAGGACCT | 29 | 2390 |
| 501308 | 23699 | 23718 | ATTCCTGACCCTGCTTAGAG | 5 | 2391 |
| 501309 | 23704 | 23723 | CCAGCATTCCTGACCCTGCT | 14 | 2392 |
| 501310 | 23709 | 23728 | GAAACCCAGCATTCCTGACC | 18 | 2393 |
| 501311 | 23714 | 23733 | GGACTGAAACCCAGCATTCC | 11 | 2394 |
| 501312 | 23719 | 23738 | AGCCAGGACTGAAACCCAGC | 34 | 2395 |
| 501313 | 23724 | 23743 | GGCAGAGCCAGGACTGAAAC | 47 | 2396 |
| 501314 | 23729 | 23748 | TAGGCGGCAGAGCCAGGACT | 43 | 2397 |
| 501315 | 23734 | 23753 | GGCAGTAGGCGGCAGAGCCA | 28 | 2398 |

TABLE 36-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501316 | 23770 | 23789 | ACCAGAGACAGGCACTGACT | 59 | 2399 |
| 501317 | 23792 | 23811 | TGGACAGCCAGGGAGACTGG | 36 | 2400 |
| 501318 | 23797 | 23816 | CTAATTGGACAGCCAGGGAG | 20 | 2401 |
| 501319 | 23802 | 23821 | ATAGCCTAATTGGACAGCCA | 63 | 2402 |
| 501320 | 23807 | 23826 | CCAGTATAGCCTAATTGGAC | 40 | 2403 |
| 501321 | 23813 | 23832 | GGTCATCCAGTATAGCCTAA | 53 | 2404 |
| 501322 | 23855 | 23874 | GACTTGCCCAGCAACCCATC | 65 | 2405 |
| 501323 | 23860 | 23879 | CTCCAGACTTGCCCAGCAAC | 28 | 2406 |
| 501324 | 23865 | 23884 | CCCACCTCCAGACTTGCCCA | 26 | 2407 |
| 501325 | 23870 | 23889 | ACTTTCCCACCTCCAGACTT | 18 | 2408 |
| 501326 | 23875 | 23894 | ATAGGACTTTCCCACCTCCA | 61 | 2409 |
| 501327 | 23880 | 23899 | CCTTCATAGGACTTTCCCAC | 56 | 2410 |
| 501328 | 23885 | 23904 | TCCTACCTTCATAGGACTTT | 40 | 2411 |
| 501329 | 23890 | 23909 | AAAAATCCTACCTTCATAGG | 0 | 2412 |
| 501330 | 23921 | 23940 | TGCCTCATAATTGCTCCTTC | 49 | 2413 |
| 501331 | 23926 | 23945 | AGGTCTGCCTCATAATTGCT | 8 | 2414 |
| 501332 | 23931 | 23950 | TCCAGAGGTCTGCCTCATAA | 64 | 2415 |
| 501333 | 23957 | 23976 | ATAAAGAGGCTGGGCCATAG | 8 | 2416 |
| 501334 | 23981 | 24000 | CAGGATGTGAACTCACAAAA | 59 | 2417 |
| 501335 | 24024 | 24043 | GTAGCATCTAATAACACCAC | 61 | 2418 |
| 501336 | 24029 | 24048 | GTTCAGTAGCATCTAATAAC | 59 | 2419 |
| 501337 | 24034 | 24053 | TGGGTGTTCAGTAGCATCTA | 50 | 2420 |
| 501338 | 24089 | 24108 | TATGTGACCCCAGGCAAGCT | 32 | 2421 |
| 501339 | 24094 | 24113 | CTCACTATGTGACCCCAGGC | 59 | 2422 |
| 501340 | 24099 | 24118 | TTCTACTCACTATGTGACCC | 56 | 2423 |
| 501341 | 24104 | 24123 | TTTGGTTCTACTCACTATGT | 57 | 2424 |
| 501342 | 24109 | 24128 | CAGACTTTGGTTCTACTCAC | 63 | 2425 |
| 501343 | 24114 | 24133 | AGGTTCAGACTTTGGTTCTA | 58 | 2426 |
| 501344 | 24119 | 24138 | AACCTAGGTTCAGACTTTGG | 59 | 2427 |
| 501345 | 24124 | 24143 | AGTCAAACCTAGGTTCAGAC | 68 | 2428 |
| 501346 | 24129 | 24148 | AGAAGAGTCAAACCTAGGTT | 56 | 2429 |
| 501347 | 24134 | 24153 | TTAGCAGAAGAGTCAAACCT | 38 | 2430 |
| 501348 | 24139 | 24158 | TTAGTTTAGCAGAAGAGTCA | 36 | 2431 |
| 501349 | 24164 | 24183 | GTGTGATGCATCAGAGGGAA | 40 | 2432 |
| 501350 | 24169 | 24188 | CCCTGGTGTGATGCATCAGA | 50 | 2433 |
| 501351 | 24174 | 24193 | CCTTTCCCTGGTGTGATGCA | 53 | 2434 |

TABLE 36-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501352 | 24197 | 24216 | AAATGCTAGGCCTCAAGATG | 17 | 2435 |
| 501353 | 24202 | 24221 | GAAGGAAATGCTAGGCCTCA | 64 | 2436 |
| 501354 | 24207 | 24226 | GGAAGGAAGGAAATGCTAGG | 31 | 2437 |
| 501355 | 24212 | 24231 | TAGGAGGAAGGAAGGAAATG | 11 | 2438 |
| 501356 | 24217 | 24236 | ACTTTTAGGAGGAAGGAAGG | 0 | 2439 |
| 501357 | 24222 | 24241 | CTTTGACTTTTAGGAGGAAG | 60 | 2440 |
| 501358 | 24227 | 24246 | AACTGCTTTGACTTTTAGGA | 39 | 2441 |
| 501359 | 24232 | 24251 | TTAACAACTGCTTTGACTTT | 30 | 2442 |
| 501360 | 24237 | 24256 | GAAAGTTAACAACTGCTTTG | 37 | 2443 |
| 501361 | 24447 | 24466 | TACCATCTGCTCTGTGAAAG | 21 | 2444 |
| 501362 | 24452 | 24471 | CTTCATACCATCTGCTCTGT | 29 | 2445 |
| 501363 | 24483 | 24502 | CAAGCACCTACTGTGTGCCC | 13 | 2446 |
| 501364 | 24488 | 24507 | TTCACCAAGCACCTACTGTG | 21 | 2447 |
| 501365 | 24493 | 24512 | ACATCTTCACCAAGCACCTA | 0 | 2448 |
| 501366 | 24516 | 24535 | CCACTACATGCCCTTTGCTC | 51 | 2449 |
| 501367 | 24557 | 24576 | CTGAAGAAGTGGGCCACCTC | 52 | 2450 |
| 501368 | 24582 | 24601 | ACCCATACCCCATTCCTTCC | 22 | 2451 |
| 501369 | 24587 | 24606 | TCCTCACCCATACCCCATTC | 9 | 2452 |
| 501370 | 24636 | 24655 | AGCCTGGTGACTGCAGGAGA | 61 | 2453 |
| 501371 | 24641 | 24660 | CAGGAAGCCTGGTGACTGCA | 45 | 2454 |
| 501372 | 24666 | 24685 | TCCAGCAGCTGATGGGCAGT | 43 | 2455 |
| 501373 | 24671 | 24690 | TGGACTCCAGCAGCTGATGG | 19 | 2456 |
| 501374 | 24695 | 24714 | CTTGGTGCCCCTAGGATGAC | 33 | 2457 |
| 501375 | 24700 | 24719 | ATTGGCTTGGTGCCCCTAGG | 8 | 2458 |
| 501376 | 24705 | 24724 | ACTTAATTGGCTTGGTGCCC | 36 | 2459 |
| 501377 | 24774 | 24793 | CACTGAGGGCTGTAATTATG | 21 | 2460 |
| 501378 | 24779 | 24798 | AAGGACACTGAGGGCTGTAA | 24 | 2461 |
| 501379 | 24784 | 24803 | GCCTGAAGGACACTGAGGGC | 2 | 2462 |
| 501380 | 24789 | 24808 | AGGCAGCCTGAAGGACACTG | 14 | 2463 |
| 413433 | 32431 | 32450 | GCCTGGACAAGTCCTGCCCA | 81 | 425 |

TABLE 37

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501226 | 21041 | 21060 | TGTTCCTGACTCCTGGGTGG | 26 | 2464 |
| 501227 | 21046 | 21065 | CTGACTGTTCCTGACTCCTG | 61 | 2465 |
| 501228 | 21091 | 21110 | TGCTGCAATCAGATGCCACC | 65 | 2466 |
| 501229 | 21096 | 21115 | GCCGATGCTGCAATCAGATG | 68 | 2467 |
| 501230 | 21101 | 21120 | GGGATGCCGATGCTGCAATC | 69 | 2468 |
| 501231 | 21119 | 21138 | GTCCAGCAGAAGCTGGTGGG | 19 | 2469 |
| 501232 | 21124 | 21143 | GAGGAGTCCAGCAGAAGCTG | 15 | 2470 |
| 501233 | 21129 | 21148 | GCTGGGAGGAGTCCAGCAGA | 12 | 2471 |
| 501234 | 21134 | 21153 | CTGTGGCTGGGAGGAGTCCA | 14 | 2472 |
| 501235 | 21139 | 21158 | CCCAGCTGTGGCTGGGAGGA | 0 | 2473 |
| 501236 | 21144 | 21163 | TCTGCCCCAGCTGTGGCTGG | 0 | 2474 |
| 501237 | 21149 | 21168 | CTTCCTCTGCCCCAGCTGTG | 41 | 2475 |
| 501238 | 21154 | 21173 | CAGTACTTCCTCTGCCCCAG | 40 | 2476 |
| 501239 | 21159 | 21178 | GCTGTCAGTACTTCCTCTGC | 50 | 2477 |
| 501240 | 21164 | 21183 | ACCTGGCTGTCAGTACTTCC | 70 | 2478 |
| 501241 | 21169 | 21188 | TTGCCACCTGGCTGTCAGTA | 68 | 2479 |
| 501242 | 21174 | 21193 | AGTCCTTGCCACCTGGCTGT | 50 | 2480 |
| 501243 | 21179 | 21198 | CTGCCAGTCCTTGCCACCTG | 53 | 2481 |
| 501244 | 21184 | 21203 | AAACACTGCCAGTCCTTGCC | 63 | 2482 |
| 501245 | 21213 | 21232 | GGAAGTGAGGGTTCAGTTGG | 30 | 2483 |
| 501246 | 21369 | 21388 | CTCTCTGGGCTTCAGTTTCC | 45 | 2484 |
| 501247 | 21374 | 21393 | CTCACCTCTCTGGGCTTCAG | 61 | 2485 |
| 501248 | 21379 | 21398 | GTCTCCTCACCTCTCTGGGC | 61 | 2486 |
| 501249 | 21384 | 21403 | GCTAAGTCTCCTCACCTCTC | 71 | 2487 |
| 501250 | 21490 | 21509 | ATCTGTTTTCCTTCAGAGGG | 55 | 2488 |
| 501251 | 21565 | 21584 | TTCCTTCTCTCTGCTCCCCA | 55 | 2489 |
| 501252 | 21570 | 21589 | CCAAGTTCCTTCTCTCTGCT | 15 | 2490 |
| 501253 | 21575 | 21594 | TGTCCCCAAGTTCCTTCTCT | 32 | 2491 |
| 501254 | 21659 | 21678 | GGTCAAGGTCACTCAGCCAG | 62 | 2492 |
| 501255 | 21681 | 21700 | CCCTATTTTGATGGTGATAC | 57 | 2493 |
| 501256 | 21708 | 21727 | TGGACTCCTGTGAGTTTGGC | 67 | 2494 |
| 501257 | 21713 | 21732 | GCACTTGGACTCCTGTGAGT | 25 | 2495 |
| 501258 | 21718 | 21737 | CACAGGCACTTGGACTCCTG | 27 | 2496 |
| 501259 | 21723 | 21742 | CCTTGCACAGGCACTTGGAC | 18 | 2497 |
| 501260 | 21728 | 21747 | CATGCCCTTGCACAGGCACT | 14 | 2498 |
| 501261 | 21733 | 21752 | CCCTCCATGCCCTTGCACAG | 29 | 2499 |

TABLE 37-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501262 | 21755 | 21774 | AGGCCCATAAAGCTTTGGGA | 49 | 2500 |
| 501263 | 21760 | 21779 | ACAAGAGGCCCATAAAGCTT | 26 | 2501 |
| 501264 | 21765 | 21784 | GATGCACAAGAGGCCCATAA | 65 | 2502 |
| 501265 | 21770 | 21789 | GGTATGATGCACAAGAGGCC | 58 | 2503 |
| 501266 | 21821 | 21840 | CTGGCCACTCTTCAGGCCCC | 32 | 2504 |
| 501267 | 21826 | 21845 | GTGCTCTGGCCACTCTTCAG | 0 | 2505 |
| 501268 | 21873 | 21892 | GATCCATATCTGGATCCCCA | 2 | 2506 |
| 501269 | 21878 | 21897 | GGTCTGATCCATATCTGGAT | 20 | 2507 |
| 501270 | 21933 | 21952 | GCTGATTACAAGCTGATTCT | 77 | 2508 |
| 501271 | 21938 | 21957 | TAACTGCTGATTACAAGCTG | 39 | 2509 |
| 501272 | 21996 | 22015 | ACAATGGAGAAACAAAAGAG | 6 | 2510 |
| 501273 | 22019 | 22038 | TTTGAAGATAAAGTCAGACC | 35 | 2511 |
| 501274 | 22075 | 22094 | GTCTATGCAGGCCTGGAATT | 54 | 2512 |
| 501275 | 22080 | 22099 | CTAAGGTCTATGCAGGCCTG | 53 | 2513 |
| 501276 | 22085 | 22104 | AAACACTAAGGTCTATGCAG | 32 | 2514 |
| 501277 | 22090 | 22109 | ATGATAAACACTAAGGTCTA | 43 | 2515 |
| 501278 | 22095 | 22114 | CTGGGATGATAAACACTAAG | 53 | 2516 |
| 501279 | 22100 | 22119 | CTTCTCTGGGATGATAAACA | 0 | 2517 |
| 501280 | 22105 | 22124 | CTTTCCTTCTCTGGGATGAT | 0 | 2518 |
| 501281 | 22126 | 22145 | AAGCCTTTGGAAAGAGAAGG | 31 | 2519 |
| 501282 | 22131 | 22150 | CCAGGAAGCCTTTGGAAAGA | 31 | 2520 |
| 501283 | 22136 | 22155 | GTCTTCCAGGAAGCCTTTGG | 51 | 2521 |
| 501284 | 22141 | 22160 | CAGCAGTCTTCCAGGAAGCC | 54 | 2522 |
| 501285 | 22146 | 22165 | TAAGGCAGCAGTCTTCCAGG | 59 | 2523 |
| 501286 | 22151 | 22170 | GGTGATAAGGCAGCAGTCTT | 56 | 2524 |
| 501287 | 22156 | 22175 | GAGATGGTGATAAGGCAGCA | 78 | 2525 |
| 501288 | 22162 | 22181 | AACCCAGAGATGGTGATAAG | 23 | 2526 |
| 501289 | 22167 | 22186 | TTCAAAACCCAGAGATGGTG | 64 | 2527 |
| 501290 | 22172 | 22191 | CATCCTTCAAAACCCAGAGA | 62 | 2528 |
| 501291 | 22194 | 22213 | CTGATAATGAGATAAAGCAA | 3 | 2529 |
| 501292 | 22231 | 22250 | CAGAGGCCCTTCCCTGCTTT | 42 | 2530 |
| 501293 | 22266 | 22285 | TGGGAGCCCCAGTCCACCT | 48 | 2531 |
| 501294 | 22271 | 22290 | GCCAGTGGGAGCCCCAGTC | 0 | 2532 |
| 501295 | 22311 | 22330 | TGGCCTGGGAGCTGGCCTGG | 13 | 2533 |
| 501296 | 22349 | 22368 | CTCTCAGGCAATCCCAACCT | 27 | 2534 |
| 501297 | 22354 | 22373 | AGGCCCTCTCAGGCAATCCC | 62 | 2535 |

TABLE 37-continued

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501298 | 22359 | 22378 | GGCCCAGGCCCTCTCAGGCA | 34 | 2536 |
| 501299 | 22364 | 22383 | TCTCAGGCCCAGGCCCTCTC | 27 | 2537 |
| 501300 | 22403 | 22422 | CTCCTGGAGAGGGAAGCTGG | 31 | 2538 |
| 501301 | 22408 | 22427 | GGAGGCTCCTGGAGAGGGAA | 0 | 2539 |
| 501302 | 22413 | 22432 | AGTTGGGAGGCTCCTGGAGA | 0 | 2540 |
| 413433 | 32431 | 32450 | GCCTGGACAAGTCCTGCCCA | 80 | 425 |

TABLE 38

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 484013 | 18880 20790 | 18899 20809 | CAGAGGCAGCTATAGGCCTG | 43 | 1299 |
| 495657 | 18871 20781 | 18890 20800 | CTATAGGCCTGGATGCCCAA | 72 | 1930 |
| 501152 | 19132 | 19151 | GCTGGAACAAAGCCTTGCAG | 52 | 2541 |
| 501153 | 19261 | 19280 | AAGAAGAGGTCGCAGAGTGA | 17 | 2542 |
| 501154 | 19360 | 19379 | GCTACTGGCATTGCTCCTCC | 75 | 2543 |
| 501155 | 19392 | 19411 | ACATGTGGCATTTGTTAGGT | 66 | 2544 |
| 501156 | 19421 | 19440 | GGAACATTAAATTTTAAAAC | 20 | 2545 |
| 501157 | 19775 | 19794 | TAGGATGAGGGTGATAATCC | 37 | 2546 |
| 501158 | 19804 | 19823 | CCTAACTCTAGCTTTGGTTT | 63 | 2547 |
| 501159 | 19809 | 19828 | AGTCACCTAACTCTAGCTTT | 20 | 2548 |
| 501160 | 19854 | 19873 | GCCCTGGGCCAGCTCTGCCC | 15 | 2549 |
| 501161 | 19867 | 19886 | TCTGAGAAAGAGGGCCCTGG | 26 | 2550 |
| 501162 | 19872 | 19891 | CTAAATCTGAGAAAGAGGGC | 0 | 2551 |
| 501163 | 19903 | 19922 | CTGAGGGCAGCAGTGTCTGA | 35 | 2552 |
| 501164 | 19908 | 19927 | CATGCCTGAGGGCAGCAGTG | 54 | 2553 |
| 501165 | 19913 | 19932 | TCTCACATGCCTGAGGGCAG | 74 | 2554 |
| 501166 | 19963 | 19982 | CAGGAAGGCCACACCTCGGG | 23 | 2555 |
| 501167 | 19968 | 19987 | GTGACCAGGAAGGCCACACC | 12 | 2556 |
| 501168 | 19973 | 19992 | TCAAAGTGACCAGGAAGGCC | 33 | 2557 |
| 501169 | 19978 | 19997 | TGATATCAAAGTGACCAGGA | 22 | 2558 |
| 501170 | 19983 | 20002 | ATATCTGATATCAAAGTGAC | 3 | 2559 |
| 501171 | 19988 | 20007 | GCCCAATATCTGATATCAAA | 74 | 2560 |
| 501172 | 20044 | 20063 | GACCCAGGGCCCAGCCCAGG | 18 | 2561 |

TABLE 38-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501173 | 20049 | 20068 | TCTCAGACCCAGGGCCCAGC | 55 | 2562 |
| 501174 | 20093 | 20112 | TGAGACTGGATTCCACCCCC | 24 | 2563 |
| 501175 | 20227 | 20246 | TACAATGCTACGCTGTTGAG | 36 | 2564 |
| 501176 | 20232 | 20251 | ATCTCTACAATGCTACGCTG | 73 | 2565 |
| 501177 | 20237 | 20256 | TCATCATCTCTACAATGCTA | 65 | 2566 |
| 501178 | 20242 | 20261 | GTCCCTCATCATCTCTACAA | 22 | 2567 |
| 501179 | 20247 | 20266 | TCCCAGTCCCTCATCATCTC | 49 | 2568 |
| 501180 | 20252 | 20271 | CAGGCTCCCAGTCCCTCATC | 16 | 2569 |
| 501181 | 20257 | 20276 | GTATTCAGGCTCCCAGTCCC | 7 | 2570 |
| 501182 | 20296 | 20315 | TGCTTGAGGTCAGGGTGTGG | 65 | 2571 |
| 501183 | 20301 | 20320 | TCACTTGCTTGAGGTCAGGG | 83 | 2572 |
| 501184 | 20306 | 20325 | CAAAATCACTTGCTTGAGGT | 72 | 2573 |
| 501185 | 20311 | 20330 | AGAGGCAAAATCACTTGCTT | 59 | 2574 |
| 501186 | 20397 | 20416 | CCACAGCACTCTCTGGGAAG | 30 | 2575 |
| 501187 | 20402 | 20421 | CCGTCCCACAGCACTCTCTG | 27 | 2576 |
| 501188 | 20407 | 20426 | CTTCACCGTCCCACAGCACT | 39 | 2577 |
| 501189 | 20442 | 20461 | GGAAAGCAATCCCCTTCTCC | 41 | 2578 |
| 501190 | 20447 | 20466 | CACCCGGAAAGCAATCCCCT | 18 | 2579 |
| 501191 | 20452 | 20471 | TTTACCACCCGGAAAGCAAT | 12 | 2580 |
| 501192 | 20457 | 20476 | GCTCTTTTACCACCCGGAAA | 55 | 2581 |
| 501193 | 20462 | 20481 | GAGCAGCTCTTTTACCACCC | 66 | 2582 |
| 501194 | 20541 | 20560 | GCAGCACTTGCTTTACACAC | 60 | 2583 |
| 501195 | 20546 | 20565 | CCCAGGCAGCACTTGCTTTA | 33 | 2584 |
| 501196 | 20551 | 20570 | CTGCTCCCAGGCAGCACTTG | 0 | 2585 |
| 501197 | 20639 | 20658 | ACAACCCTGCTACCTACAGA | 23 | 2586 |
| 501198 | 20644 | 20663 | GGAACACAACCCTGCTACCT | 37 | 2587 |
| 501199 | 20668 | 20687 | GTACAAGTTTCTCCACCTAT | 80 | 2588 |
| 501200 | 20673 | 20692 | CCTAGGTACAAGTTTCTCCA | 79 | 2589 |
| 501201 | 20714 | 20733 | GGACTGACCCCAGAGATGGG | 22 | 2590 |
| 501202 | 20719 | 20738 | ACTGAGGACTGACCCCAGAG | 0 | 2591 |
| 501203 | 20724 | 20743 | CCATCACTGAGGACTGACCC | 33 | 2592 |
| 501204 | 20729 | 20748 | CAGCCCCATCACTGAGGACT | 18 | 2593 |
| 501205 | 20771 | 20790 | GGATGCCCAAGTTAGACTGG | 24 | 2594 |
| 495670 | 20776 | 20795 | GGCCTGGATGCCCAAGTTAG | 69 | 1943 |
| 501206 | 20802 | 20821 | CCAGAGCAGCCTCAGAGGCA | 55 | 2595 |
| 501207 | 20807 | 20826 | CAAATCCAGAGCAGCCTCAG | 13 | 2596 |

TABLE 38-continued

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501208 | 20812 | 20831 | ATAAGCAAATCCAGAGCAGC | 18 | 2597 |
| 501209 | 20817 | 20836 | AATCCATAAGCAAATCCAGA | 60 | 2598 |
| 501210 | 20822 | 20841 | GAGCAAATCCATAAGCAAAT | 70 | 2599 |
| 501211 | 20827 | 20846 | TAGCTGAGCAAATCCATAAG | 58 | 2600 |
| 501212 | 20832 | 20851 | CTGCATAGCTGAGCAAATCC | 79 | 2601 |
| 501213 | 20837 | 20856 | GTTTACTGCATAGCTGAGCA | 84 | 2602 |
| 501214 | 20842 | 20861 | TAGAGGTTTACTGCATAGCT | 75 | 2603 |
| 501215 | 20868 | 20887 | GATTCATCTGTGGTAAGAGG | 55 | 2604 |
| 501216 | 20873 | 20892 | TACCTGATTCATCTGTGGTA | 44 | 2605 |
| 501217 | 20878 | 20897 | CTTGGTACCTGATTCATCTG | 64 | 2606 |
| 501218 | 20884 | 20903 | CCAGGACTTGGTACCTGATT | 54 | 2607 |
| 501219 | 20889 | 20908 | GGGTGCCAGGACTTGGTACC | 26 | 2608 |
| 501220 | 20913 | 20932 | GCCATCCCACTGCCAGTGAC | 23 | 2609 |
| 501221 | 20937 | 20956 | ACAGCACCAATGTCACTTTA | 55 | 2610 |
| 501222 | 20950 | 20969 | TCTGCACACTCCCACAGCAC | 52 | 2611 |
| 501223 | 20955 | 20974 | CTCTCTCTGCACACTCCCAC | 59 | 2612 |
| 501224 | 20960 | 20979 | CTGCACTCTCTCTGCACACT | 76 | 2613 |
| 413433 | 32431 | 32450 | GCCTGGACAAGTCCTGCCCA | 77 | 425 |

TABLE 39

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501075 | 16484 | 16503 | GTCCTGGCCTCTACCCTGAA | 57 | 2614 |
| 501076 | 16510 | 16529 | GAAGGACTGGGATGCTAGGT | 65 | 2615 |
| 501077 | 16515 | 16534 | GGCATGAAGGACTGGGATGC | 49 | 2616 |
| 501078 | 16520 | 16539 | AGGGAGGCATGAAGGACTGG | 22 | 2617 |
| 501079 | 16525 | 16544 | GAAACAGGGAGGCATGAAGG | 21 | 2618 |
| 501080 | 16530 | 16549 | GTAGAGAAACAGGGAGGCAT | 34 | 2619 |
| 501081 | 16535 | 16554 | GAAAAGTAGAGAAACAGGGA | 0 | 2620 |
| 501082 | 16540 | 16559 | AGTTGGAAAAGTAGAGAAAC | 11 | 2621 |
| 501083 | 16546 | 16565 | GAGTCTAGTTGGAAAAGTAG | 1 | 2622 |
| 501084 | 16551 | 16570 | ACTGTGAGTCTAGTTGGAAA | 33 | 2623 |
| 501085 | 16556 | 16575 | CAGAGACTGTGAGTCTAGTT | 51 | 2624 |

TABLE 39-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501086 | 16561 | 16580 | CAGCACAGAGACTGTGAGTC | 59 | 2625 |
| 501087 | 16566 | 16585 | GACTGCAGCACAGAGACTGT | 29 | 2626 |
| 501088 | 16571 | 16590 | AGTCAGACTGCAGCACAGAG | 25 | 2627 |
| 501089 | 16576 | 16595 | AGTTTAGTCAGACTGCAGCA | 35 | 2628 |
| 501090 | 16673 | 16692 | GATGCCTTCCAGGAGGAAGG | 19 | 2629 |
| 501091 | 16678 | 16697 | TTAGGGATGCCTTCCAGGAG | 31 | 2630 |
| 501092 | 16683 | 16702 | TGTTCTTAGGGATGCCTTCC | 44 | 2631 |
| 501093 | 16808 | 16827 | AGGCTGAGTTCTGCTCCTGG | 72 | 2632 |
| 501094 | 16813 | 16832 | GCTAGAGGCTGAGTTCTGCT | 83 | 2633 |
| 501095 | 16818 | 16837 | CATCTGCTAGAGGCTGAGTT | 67 | 2634 |
| 501096 | 16823 | 16842 | TTGGGCATCTGCTAGAGGCT | 65 | 2635 |
| 501097 | 16828 | 16847 | GCTTCTTGGGCATCTGCTAG | 75 | 2636 |
| 501098 | 16833 | 16852 | CCTCTGCTTCTTGGGCATCT | 84 | 2637 |
| 501099 | 16896 | 16915 | TTTCTAAGTACCCTTTACAC | 34 | 2638 |
| 501100 | 16901 | 16920 | AGTGCTTTCTAAGTACCCTT | 86 | 2639 |
| 501101 | 16941 | 16960 | GGAGAGAGAAGGGTGGAACC | 26 | 2640 |
| 501102 | 16949 | 16968 | AGAGGAAGGGAGAGAGAAGG | 13 | 2641 |
| 501103 | 17007 | 17026 | GGGAAAGGTCTTCTCCAGCT | 89 | 2642 |
| 501104 | 17012 | 17031 | CAGGAGGGAAAGGTCTTCTC | 60 | 2643 |
| 501105 | 17017 | 17036 | GGAATCAGGAGGGAAAGGTC | 25 | 2644 |
| 501106 | 17038 | 17057 | GGGTCAAGCAGAGCTTTCTG | 66 | 2645 |
| 501107 | 17109 | 17128 | ATGAATAAACAGGGCCTAGA | 37 | 2646 |
| 501108 | 17114 | 17133 | CTGTGATGAATAAACAGGGC | 67 | 2647 |
| 501109 | 17138 | 17157 | TGAATGACTGAATGCTTGAG | 39 | 2648 |
| 501110 | 17143 | 17162 | TTTGCTGAATGACTGAATGC | 53 | 2649 |
| 501111 | 17207 | 17226 | TCTCATTCATCTGGGCCCTG | 72 | 2650 |
| 501112 | 17244 | 17263 | TGGGAAAGGTATGTGTGTG | 16 | 2651 |
| 501113 | 17249 | 17268 | CATTATGGGAAAGGTATGT | 8 | 2652 |
| 501114 | 17254 | 17273 | TTTCTCATTATGGGAAAAGG | 38 | 2653 |
| 501115 | 17259 | 17278 | AGCCCTTTCTCATTATGGGA | 47 | 2654 |
| 501116 | 17264 | 17283 | TACTCAGCCCTTTCTCATTA | 43 | 2655 |
| 501117 | 17269 | 17288 | CCCTGTACTCAGCCCTTTCT | 65 | 2656 |
| 501118 | 17274 | 17293 | CTCACCCCTGTACTCAGCCC | 73 | 2657 |
| 501119 | 17279 | 17298 | CCCATCTCACCCCTGTACTC | 66 | 2658 |
| 501120 | 17284 | 17303 | CCTGTCCCATCTCACCCCTG | 13 | 2659 |
| 501121 | 17289 | 17308 | CCCTGCCTGTCCCATCTCAC | 36 | 2660 |

TABLE 39-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501122 | 17328 | 17347 | AGTCTTCCTTCTCCTCCACC | 75 | 2661 |
| 501123 | 17333 | 17352 | TGGAAAGTCTTCCTTCTCCT | 72 | 2662 |
| 501124 | 17338 | 17357 | TTCTCTGGAAAGTCTTCCTT | 66 | 2663 |
| 501125 | 17420 | 17439 | TTGGTCAGTCTTTTAGCACA | 64 | 2664 |
| 501126 | 17425 | 17444 | CTAGTTTGGTCAGTCTTTTA | 68 | 2665 |
| 501127 | 17450 | 17469 | AGGTAGAGTTCTATTGCTTC | 81 | 2666 |
| 501128 | 17530 | 17549 | GTCTCCACTTGGTGCCTCAC | 72 | 2667 |
| 501129 | 17535 | 17554 | AAGCTGTCTCCACTTGGTGC | 61 | 2668 |
| 501130 | 17540 | 17559 | ACAGGAAGCTGTCTCCACTT | 69 | 2669 |
| 501131 | 17545 | 17564 | CTCACACAGGAAGCTGTCTC | 44 | 2670 |
| 501132 | 17614 | 17633 | AGCTGCCATCTCTGGAGGGT | 15 | 2671 |
| 501133 | 17619 | 17638 | GGCAAAGCTGCCATCTCTGG | 52 | 2672 |
| 501134 | 17624 | 17643 | GTCATGGCAAAGCTGCCATC | 7 | 2673 |
| 501135 | 17664 | 17683 | CCTTTCAGCGGGAGTCCACA | 44 | 2674 |
| 501136 | 17687 | 17706 | TTCCAGGCTCCTCCAGGCAG | 36 | 2675 |
| 501137 | 17692 | 17711 | CTCTCTTCCAGGCTCCTCCA | 44 | 2676 |
| 501138 | 17720 | 17739 | ATGCCACTTCATCAAGGCTG | 33 | 2677 |
| 501139 | 17725 | 17744 | AAGAGATGCCACTTCATCAA | 36 | 2678 |
| 501140 | 17730 | 17749 | TGCCAAAGAGATGCCACTTC | 63 | 2679 |
| 501141 | 17735 | 17754 | CCAAGTGCCAAAGAGATGCC | 39 | 2680 |
| 501142 | 17740 | 17759 | TCAGGCCAAGTGCCAAAGAG | 30 | 2681 |
| 501143 | 17745 | 17764 | GGAAGTCAGGCCAAGTGCCA | 38 | 2682 |
| 501144 | 17750 | 17769 | GTCTAGGAAGTCAGGCCAAG | 46 | 2683 |
| 501145 | 17755 | 17774 | GGGAGGTCTAGGAAGTCAGG | 19 | 2684 |
| 501146 | 17760 | 17779 | CCCCAGGGAGGTCTAGGAAG | 32 | 2685 |
| 501147 | 17765 | 17784 | TCCAGCCCCAGGGAGGTCTA | 30 | 2686 |
| 501148 | 17770 | 17789 | GCTCTTCCAGCCCCAGGGAG | 36 | 2687 |
| 501149 | 17804 | 17823 | AGAGTGAGGGTCAGTACATA | 15 | 2688 |
| 501150 | 17809 | 17828 | GTAGCAGAGTGAGGGTCAGT | 28 | 2689 |
| 501151 | 17933 | 17952 | TAGGTGAGTGAGAAAGTCAC | 16 | 2690 |
| 413433 | 32431 | 32450 | GCCTGGACAAGTCCTGCCCA | 78 | 425 |

TABLE 40

Inhibition of DGAT2 mRNA by 5-10-5 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500994 | 15257 | 15276 | CATCTGCACCATAATCTGCA | 72 | 2691 |
| 500995 | 15292 | 15311 | TTTACCCAAAAGGTTCACAG | 64 | 2692 |
| 500996 | 15297 | 15316 | ATTGATTTACCCAAAAGGTT | 32 | 2693 |
| 500997 | 15318 | 15337 | GAGTTTGTGTTTCCCATTTC | 69 | 2694 |
| 500998 | 15323 | 15342 | AAAAGGAGTTTGTGTTTCCC | 81 | 2695 |
| 500999 | 15328 | 15347 | ATAAGAAAAGGAGTTTGTGT | 30 | 2696 |
| 501000 | 15333 | 15352 | CTCTAATAAGAAAAGGAGTT | 33 | 2697 |
| 501001 | 15338 | 15357 | TTCTGCTCTAATAAGAAAAG | 12 | 2698 |
| 501002 | 15343 | 15362 | GCTAATTCTGCTCTAATAAG | 28 | 2699 |
| 501003 | 15348 | 15367 | GAATGGCTAATTCTGCTCTA | 48 | 2700 |
| 501004 | 15353 | 15372 | GCTTAGAATGGCTAATTCTG | 69 | 2701 |
| 501005 | 15358 | 15377 | GCAGGGCTTAGAATGGCTAA | 59 | 2702 |
| 501006 | 15363 | 15382 | CAGAGGCAGGGCTTAGAATG | 56 | 2703 |
| 501007 | 15368 | 15387 | GGAAGCAGAGGCAGGGCTTA | 68 | 2704 |
| 501008 | 15373 | 15392 | ACATGGGAAGCAGAGGCAGG | 66 | 2705 |
| 501009 | 15378 | 15397 | AGGTCACATGGGAAGCAGAG | 57 | 2706 |
| 501010 | 15431 | 15450 | TCCTCACTGTGCAGATGAGA | 30 | 2707 |
| 501011 | 15436 | 15455 | AGTCCTCCTCACTGTGCAGA | 48 | 2708 |
| 501012 | 15441 | 15460 | CAACCAGTCCTCCTCACTGT | 33 | 2709 |
| 501013 | 15446 | 15465 | CATCTCAACCAGTCCTCCTC | 52 | 2710 |
| 501014 | 15504 | 15523 | TTAGGGACAAGAATGGAATC | 23 | 2711 |
| 501015 | 15509 | 15528 | AGCAGTTAGGGACAAGAATG | 10 | 2712 |
| 501016 | 15514 | 15533 | CCCACAGCAGTTAGGGACAA | 63 | 2713 |
| 501017 | 15568 | 15587 | TTTTCACAAGGAGAAGCTGA | 47 | 2714 |
| 501018 | 15573 | 15592 | CACCATTTTCACAAGGAGAA | 76 | 2715 |
| 501019 | 15578 | 15597 | GAGTGCACCATTTTCACAAG | 71 | 2716 |
| 501020 | 15646 | 15665 | ATCACAATATATGGGCAAGC | 82 | 2717 |
| 501021 | 15651 | 15670 | TCCCCATCACAATATATGGG | 39 | 2718 |
| 501022 | 15671 | 15690 | CAAGGAATCTCCAAAATACG | 37 | 2719 |
| 501023 | 15703 | 15722 | ATGGCAACACTACTAGCTTG | 27 | 2720 |
| 501024 | 15708 | 15727 | CTGCCATGGCAACACTACTA | 56 | 2721 |
| 501025 | 15729 | 15748 | TAGCTACTGCAGTGGAAGGG | 71 | 2722 |
| 501026 | 15734 | 15753 | AAAAGTAGCTACTGCAGTGG | 69 | 2723 |
| 501027 | 15739 | 15758 | ATTCAAAAGTAGCTACTGC | 59 | 2724 |
| 501028 | 15744 | 15763 | AGCACATTCAAAAGTAGCT | 59 | 2725 |
| 501029 | 15804 | 15823 | CTGGACATGATTGCTGAGGA | 63 | 2726 |

TABLE 40-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501030 | 15809 | 15828 | GGACCCTGGACATGATTGCT | 74 | 2727 |
| 501031 | 15814 | 15833 | ATCCAGGACCCTGGACATGA | 69 | 2728 |
| 501032 | 15839 | 15858 | TTCCTGATACCGAACATGGA | 22 | 2729 |
| 501033 | 15876 | 15895 | GGTAAGGCCAAGGAAGTGAG | 78 | 2730 |
| 501034 | 15881 | 15900 | CAAGAGGTAAGGCCAAGGAA | 80 | 2731 |
| 501035 | 15933 | 15952 | ACCTGGGTTTTGTGTATTC | 82 | 2732 |
| 501036 | 15938 | 15957 | CATACACCTGGGTTTTGTG | 57 | 2733 |
| 501037 | 15943 | 15962 | TACTCCATACACCTGGGTTT | 69 | 2734 |
| 501038 | 15991 | 16010 | TTATCCACAGAAGATCTCCC | 75 | 2735 |
| 501039 | 16046 | 16065 | CTGAGTGCTGCTAACTTGGG | 70 | 2736 |
| 501040 | 16051 | 16070 | GAAATCTGAGTGCTGCTAAC | 78 | 2737 |
| 501041 | 16082 | 16101 | CACTAAATTAGGAAGCTGGG | 79 | 2738 |
| 501043 | 16105 | 16124 | CCCTCTCTAGGTTTCCCCAT | 63 | 2739 |
| 501045 | 16110 | 16129 | TCCTCCCCTCTCTAGGTTTC | 34 | 2740 |
| 501047 | 16115 | 16134 | CCTCTTCCTCCCCTCTCTAG | 24 | 2741 |
| 501049 | 16120 | 16139 | CTAAGCCTCTTCCTCCCCTC | 33 | 2742 |
| 501050 | 16171 | 16190 | GCCTGCTGCAGGGAGCCAGG | 4 | 2743 |
| 501051 | 16208 | 16227 | GGCCATCAGGACCCTGCAGG | 30 | 2744 |
| 501052 | 16213 | 16232 | AAGTGGGCCATCAGGACCCT | 5 | 2745 |
| 501053 | 16227 | 16246 | GTGTGCCAGGTGGGAAGTGG | 0 | 2746 |
| 501054 | 16232 | 16251 | GCTAGGTGTGCCAGGTGGGA | 38 | 2747 |
| 501055 | 16237 | 16256 | GCTATGCTAGGTGTGCCAGG | 62 | 2748 |
| 501056 | 16242 | 16261 | ACACAGCTATGCTAGGTGTG | 22 | 2749 |
| 501057 | 16247 | 16266 | CCAGCACACAGCTATGCTAG | 25 | 2750 |
| 501058 | 16252 | 16271 | GAGAGCCAGCACACAGCTAT | 44 | 2751 |
| 501059 | 16257 | 16276 | TACTGGAGAGCCAGCACACA | 57 | 2752 |
| 501060 | 16262 | 16281 | CAAACTACTGGAGAGCCAGC | 59 | 2753 |
| 501061 | 16288 | 16307 | TGGGACATCTGGCCCAAAGG | 67 | 2754 |
| 501062 | 16293 | 16312 | CCCACTGGGACATCTGGCCC | 77 | 2755 |
| 501063 | 16305 | 16324 | CTTAAAGCAGGGCCCACTGG | 49 | 2756 |
| 501064 | 16310 | 16329 | GTATCCTTAAAGCAGGGCCC | 80 | 2757 |
| 501065 | 16364 | 16383 | TTCTTTTCTGAAAAGATTAA | 16 | 2758 |
| 501066 | 16369 | 16388 | GTGAGTTCTTTTCTGAAAAG | 48 | 2759 |
| 501067 | 16428 | 16447 | ACTGGTGCCTAAGAGCCCTA | 76 | 2760 |
| 501068 | 16433 | 16452 | CCTCCACTGGTGCCTAAGAG | 66 | 2761 |
| 501069 | 16438 | 16457 | CACTCCCTCCACTGGTGCCT | 71 | 2762 |

TABLE 40-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501070 | 16459 | 16478 | AGAAGACAGCCAGTCAGAGC | 67 | 2763 |
| 501071 | 16464 | 16483 | GGCAGAGAAGACAGCCAGTC | 53 | 2764 |
| 501072 | 16469 | 16488 | CTGAAGGCAGAGAAGACAGC | 11 | 2765 |
| 501073 | 16474 | 16493 | CTACCCTGAAGGCAGAGAAG | 0 | 2766 |
| 501074 | 16479 | 16498 | GGCCTCTACCCTGAAGGCAG | 1 | 2767 |
| 413433 | 32431 | 32450 | GCCTGGACAAGTCCTGCCCA | 79 | 425 |

TABLE 41

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500917 | 12407 | 12426 | TGTCAGAAAGGACTCCTCTG | 37 | 2768 |
| 500918 | 12412 | 12431 | ACAGCTGTCAGAAAGGACTC | 47 | 2769 |
| 500919 | 12417 | 12436 | CCTCAACAGCTGTCAGAAAG | 22 | 2770 |
| 500920 | 12439 | 12458 | ACCCACCCCAGCCTGTTGCA | 56 | 2771 |
| 500921 | 12474 | 12493 | CAAGCAGATCCACAGTGATG | 16 | 2772 |
| 500922 | 12479 | 12498 | AGTTTCAAGCAGATCCACAG | 37 | 2773 |
| 500923 | 12500 | 12519 | CCCCCAACAATCTAGCCACT | 41 | 2774 |
| 500924 | 12505 | 12524 | AGTTACCCCCAACAATCTAG | 16 | 2775 |
| 500925 | 12510 | 12529 | TTCCCAGTTACCCCCAACAA | 16 | 2776 |
| 500926 | 12515 | 12534 | CTCAGTTCCCAGTTACCCCC | 44 | 2777 |
| 500927 | 12520 | 12539 | CAACCCTCAGTTCCCAGTTA | 26 | 2778 |
| 500928 | 12549 | 12568 | TCTGACTTAGGACTAGGTTA | 70 | 2779 |
| 500929 | 12554 | 12573 | CTCATTCTGACTTAGGACTA | 64 | 2780 |
| 500930 | 12559 | 12578 | ATGTTCTCATTCTGACTTAG | 44 | 2781 |
| 500931 | 12564 | 12583 | GAGTAATGTTCTCATTCTGA | 44 | 2782 |
| 500932 | 12569 | 12588 | CATGAGAGTAATGTTCTCAT | 44 | 2783 |
| 500933 | 12618 | 12637 | GGAAGTGATGTAGGTGAGGG | 23 | 2784 |
| 500934 | 12671 | 12690 | AGCCTAGATGAGCCCTTGGT | 65 | 2785 |
| 500935 | 12676 | 12695 | TTCTCAGCCTAGATGAGCCC | 69 | 2786 |
| 500936 | 12681 | 12700 | CTCCTTTCTCAGCCTAGATG | 52 | 2787 |
| 500937 | 12686 | 12705 | TGGCCCTCCTTTCTCAGCCT | 54 | 2788 |
| 500938 | 12691 | 12710 | ACTCTTGGCCCTCCTTTCTC | 26 | 2789 |
| 500939 | 12696 | 12715 | ACATTACTCTTGGCCCTCCT | 59 | 2790 |

TABLE 41-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500940 | 12779 | 12798 | TTGCTGTTGAATTTGAGGGC | 53 | 2791 |
| 500941 | 12784 | 12803 | AGTACTTGCTGTTGAATTTG | 45 | 2792 |
| 500942 | 12806 | 12825 | CAGCACTAATTTTTACAACT | 78 | 2793 |
| 500943 | 12834 | 12853 | ATCTGTAACATGAGGGTTGG | 36 | 2794 |
| 500944 | 12839 | 12858 | ATCCCATCTGTAACATGAGG | 69 | 2795 |
| 500945 | 12844 | 12863 | CAGTGATCCCATCTGTAACA | 67 | 2796 |
| 500946 | 12890 | 12909 | GCCTGGCTTTGATAACCCTG | 63 | 2797 |
| 500947 | 12895 | 12914 | TTCTAGCCTGGCTTTGATAA | 20 | 2798 |
| 500948 | 12917 | 12936 | CAGACTGGGAGATGGATCTG | 31 | 2799 |
| 500949 | 12922 | 12941 | GGCCACAGACTGGGAGATGG | 47 | 2800 |
| 500950 | 12927 | 12946 | AGTCAGGCCACAGACTGGGA | 72 | 2801 |
| 500951 | 12932 | 12951 | TAAGGAGTCAGGCCACAGAC | 47 | 2802 |
| 500952 | 12937 | 12956 | TGGCTTAAGGAGTCAGGCCA | 43 | 2803 |
| 500953 | 12942 | 12961 | TCTCTTGGCTTAAGGAGTCA | 71 | 2804 |
| 500954 | 12977 | 12996 | GCCCTGCACTCAGCCCTTCA | 19 | 2805 |
| 500955 | 12982 | 13001 | ACAGAGCCCTGCACTCAGCC | 54 | 2806 |
| 500956 | 13026 | 13045 | GACAACCTTCACTCATTCAG | 35 | 2807 |
| 500957 | 13098 | 13117 | ATCCACTAGGGCAGGCTTGG | 69 | 2808 |
| 500958 | 13202 | 13221 | GGCCAGGAGGAAGAGTTTGG | 39 | 2809 |
| 500959 | 13207 | 13226 | TCATAGGCCAGGAGGAAGAG | 20 | 2810 |
| 500960 | 13212 | 13231 | TTACTTCATAGGCCAGGAGG | 63 | 2811 |
| 500961 | 13239 | 13258 | TGGCAGTGGAGGCTGTTCAC | 63 | 2812 |
| 500962 | 13306 | 13325 | GCAGGAACAGGAAGACCACC | 0 | 2813 |
| 500963 | 13311 | 13330 | ATGCTGCAGGAACAGGAAGA | 51 | 2814 |
| 500964 | 13316 | 13335 | GAGTAATGCTGCAGGAACAG | 35 | 2815 |
| 500965 | 13321 | 13340 | ATTGGGAGTAATGCTGCAGG | 55 | 2816 |
| 500966 | 13441 | 13460 | TGGCTCTCTAGATAGGGTGG | 75 | 2817 |
| 500967 | 13485 | 13504 | TAAAAGAAGATGTGGTGATT | 0 | 2818 |
| 500968 | 13490 | 13509 | AAAAATAAAGAAGATGTGG | 0 | 2819 |
| 500969 | 13495 | 13514 | GCTATAAAAATAAAGAAGA | 0 | 2820 |
| 500970 | 13500 | 13519 | TAAAGGCTATAAAAATAAAA | 0 | 2821 |
| 500971 | 13542 | 13561 | ATTGCTTAAACAGATAAGCA | 6 | 2822 |
| 500972 | 13547 | 13566 | AGACAATTGCTTAAACAGAT | 32 | 2823 |
| 500973 | 13916 | 13935 | GTTCCTGTTTCCAAGGGACT | 59 | 2824 |
| 500974 | 13921 | 13940 | ACAAGGTTCCTGTTTCCAAG | 69 | 2825 |
| 500975 | 13926 | 13945 | GACAGACAAGGTTCCTGTTT | 72 | 2826 |

TABLE 41-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500976 | 13931 | 13950 | AGAAAGACAGACAAGGTTCC | 51 | 2827 |
| 500977 | 13936 | 13955 | CACTGAGAAAGACAGACAAG | 0 | 2828 |
| 500978 | 13941 | 13960 | CACAGCACTGAGAAAGACAG | 36 | 2829 |
| 500979 | 13962 | 13981 | GCCAGGCACTGTGCTAGATG | 63 | 2830 |
| 500980 | 13967 | 13986 | CCAGTGCCAGGCACTGTGCT | 37 | 2831 |
| 500981 | 13972 | 13991 | TATTACCAGTGCCAGGCACT | 13 | 2832 |
| 500982 | 13977 | 13996 | GTACCTATTACCAGTGCCAG | 64 | 2833 |
| 500983 | 13982 | 14001 | ACTAAGTACCTATTACCAGT | 7 | 2834 |
| 500984 | 14054 | 14073 | AGCTAAAAGCAGGGCTTCCT | 0 | 2835 |
| 500985 | 14177 | 14196 | GCTCCTTGCCAGACTGTGGG | 60 | 2836 |
| 500986 | 14182 | 14201 | AGCCAGCTCCTTGCCAGACT | 75 | 2837 |
| 500987 | 14187 | 14206 | CTTGGAGCCAGCTCCTTGCC | 54 | 2838 |
| 500988 | 14192 | 14211 | TCAGCCTTGGAGCCAGCTCC | 35 | 2839 |
| 500989 | 14197 | 14216 | GCCACTCAGCCTTGGAGCCA | 76 | 2840 |
| 500990 | 14239 | 14258 | GGAAGCAGTAAGGGTGACCA | 73 | 2841 |
| 500991 | 14246 | 14265 | AGCCCTGGGAAGCAGTAAGG | 11 | 2842 |
| 500992 | 14251 | 14270 | TAATAAGCCCTGGGAAGCAG | 0 | 2843 |
| 500993 | 14327 | 14346 | ATCCCCAGAGAGGAAGTGAA | 0 | 2844 |
| 413433 | 32431 | 32450 | GCCTGGACAAGTCCTGCCCA | 80 | 425 |

TABLE 42

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500840 | 11204 | 11223 | ATAACCACAGCGATAATCAC | 45 | 2845 |
| 500841 | 11209 | 11228 | GGCAGATAACCACAGCGATA | 79 | 2846 |
| 500842 | 11228 | 11247 | CAGCACCCACACCAAGAGGG | 38 | 2847 |
| 500843 | 11318 | 11337 | TCAGAGGCTACTGGCTGGAT | 69 | 2848 |
| 500844 | 11323 | 11342 | GGCTGTCAGAGGCTACTGGC | 75 | 2849 |
| 500845 | 11346 | 11365 | AAAAGGACTCAAGTGAGAGA | 24 | 2850 |
| 500846 | 11351 | 11370 | AACAGAAAAGGACTCAAGTG | 4 | 2851 |
| 500847 | 11356 | 11375 | CAGGGAACAGAAAAGGACTC | 30 | 2852 |
| 500848 | 11361 | 11380 | GGACACAGGGAACAGAAAAG | 2 | 2853 |

TABLE 42-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500849 | 11366 | 11385 | TCAAAGGACACAGGGAACAG | 24 | 2854 |
| 500850 | 11371 | 11390 | GGACATCAAAGGACACAGGG | 3 | 2855 |
| 500851 | 11376 | 11395 | CCTAAGGACATCAAAGGACA | 3 | 2856 |
| 500852 | 11413 | 11432 | GCATGAACAAGGGCAAGTCC | 74 | 2857 |
| 500853 | 11457 | 11476 | AGAACATCCCTATCCCACTG | 37 | 2858 |
| 500854 | 11462 | 11481 | CACAGAGAACATCCCTATCC | 59 | 2859 |
| 500855 | 11509 | 11528 | CCTGTGGATGGCAGAGCCGA | 32 | 2860 |
| 500856 | 11514 | 11533 | CCCAGCCTGTGGATGGCAGA | 21 | 2861 |
| 500857 | 11519 | 11538 | CAGCTCCCAGCCTGTGGATG | 0 | 2862 |
| 500858 | 11553 | 11572 | CATGACAGCCAGGGTCACTG | 57 | 2863 |
| 500859 | 11559 | 11578 | CAAAAACATGACAGCCAGGG | 80 | 2864 |
| 500860 | 11564 | 11583 | TAAGTCAAAACATGACAGC | 24 | 2865 |
| 500861 | 11569 | 11588 | AACTCTAAGTCAAAACATG | 0 | 2866 |
| 500862 | 11574 | 11593 | GAACAAACTCTAAGTCAAAA | 5 | 2867 |
| 500863 | 11579 | 11598 | CTAAGGAACAAACTCTAAGT | 19 | 2868 |
| 500864 | 11584 | 11603 | TTCTCCTAAGGAACAAACTC | 31 | 2869 |
| 500865 | 11589 | 11608 | ACAAGTTCTCCTAAGGAACA | 28 | 2870 |
| 500866 | 11594 | 11613 | AGAGTACAAGTTCTCCTAAG | 66 | 2871 |
| 500867 | 11599 | 11618 | TCGCTAGAGTACAAGTTCTC | 81 | 2872 |
| 500868 | 11635 | 11654 | TCCTGACATGATATTAAGTG | 50 | 2873 |
| 500869 | 11640 | 11659 | AATGTTCCTGACATGATATT | 5 | 2874 |
| 500870 | 11707 | 11726 | ATGATGTAAATCCTTGCACC | 68 | 2875 |
| 500871 | 11712 | 11731 | ATTCCATGATGTAAATCCTT | 63 | 2876 |
| 500872 | 11717 | 11736 | CCTACATTCCATGATGTAAA | 45 | 2877 |
| 500873 | 11722 | 11741 | CCCTTCCTACATTCCATGAT | 56 | 2878 |
| 500874 | 11727 | 11746 | ACCAGCCCTTCCTACATTCC | 54 | 2879 |
| 500875 | 11732 | 11751 | TTCATACCAGCCCTTCCTAC | 22 | 2880 |
| 500876 | 11755 | 11774 | AAGCTGAACTGACTGGTTTG | 41 | 2881 |
| 500877 | 11760 | 11779 | CCAGAAAGCTGAACTGACTG | 0 | 2882 |
| 500878 | 11765 | 11784 | AGATCCCAGAAAGCTGAACT | 29 | 2883 |
| 500879 | 11770 | 11789 | AAAGTAGATCCCAGAAAGCT | 15 | 2884 |
| 500880 | 11775 | 11794 | TCACCAAAGTAGATCCCAGA | 58 | 2885 |
| 500881 | 11780 | 11799 | ATCTTTCACCAAAGTAGATC | 33 | 2886 |
| 500882 | 11785 | 11804 | ACCCAATCTTTCACCAAAGT | 18 | 2887 |
| 500883 | 11790 | 11809 | ACTCCACCCAATCTTTCACC | 49 | 2888 |
| 500884 | 11795 | 11814 | CCCCTACTCCACCCAATCTT | 14 | 2889 |

TABLE 42-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 500885 | 11800 | 11819 | GCCCTCCCCTACTCCACCCA | 32 | 2890 |
| 500886 | 11805 | 11824 | TCAGTGCCCTCCCCTACTCC | 26 | 2891 |
| 500887 | 11827 | 11846 | TGCCCAGATAACAAAATGTG | 29 | 2892 |
| 500888 | 11832 | 11851 | GGAGATGCCCAGATAACAAA | 56 | 2893 |
| 500889 | 11857 | 11876 | CAAGGATCTAGAAGGCAGGT | 59 | 2894 |
| 500890 | 11862 | 11881 | AGGACCAAGGATCTAGAAGG | 28 | 2895 |
| 500891 | 11867 | 11886 | CTTCAAGGACCAAGGATCTA | 30 | 2896 |
| 500892 | 11872 | 11891 | AGTATCTTCAAGGACCAAGG | 72 | 2897 |
| 500893 | 11893 | 11912 | AGGCAAACTAGGCCACTGGG | 20 | 2898 |
| 500894 | 11898 | 11917 | CACAGAGGCAAACTAGGCCA | 4 | 2899 |
| 500895 | 11920 | 11939 | CTCACAACAGTGGGACCTTA | 69 | 2900 |
| 500896 | 11925 | 11944 | ACCAGCTCACAACAGTGGGA | 43 | 2901 |
| 500897 | 11930 | 11949 | TGTTCACCAGCTCACAACAG | 8 | 2902 |
| 500898 | 11964 | 11983 | CATGGTCTCTACTTGAATAC | 14 | 2903 |
| 500899 | 11969 | 11988 | GAATCCATGGTCTCTACTTG | 18 | 2904 |
| 500900 | 11974 | 11993 | TCACAGAATCCATGGTCTCT | 42 | 2905 |
| 500901 | 11979 | 11998 | TCCCTTCACAGAATCCATGG | 36 | 2906 |
| 500902 | 11984 | 12003 | GGACTTCCCTTCACAGAATC | 23 | 2907 |
| 500903 | 11989 | 12008 | TCACAGGACTTCCCTTCACA | 47 | 2908 |
| 500904 | 12070 | 12089 | ACCTACCCATACTCCCACAG | 31 | 2909 |
| 500905 | 12075 | 12094 | CACCCACCTACCCATACTCC | 15 | 2910 |
| 500906 | 12080 | 12099 | GCATGCACCCACCTACCCAT | 41 | 2911 |
| 500907 | 12085 | 12104 | CCCCAGCATGCACCCACCTA | 14 | 2912 |
| 500908 | 12090 | 12109 | GCTTCCCCCAGCATGCACCC | 36 | 2913 |
| 500909 | 12138 | 12157 | GGCACAGGACAGCCCTCCAA | 54 | 2914 |
| 500910 | 12169 | 12188 | TGTCCTGATGAACTCTGCAA | 54 | 2915 |
| 500911 | 12242 | 12261 | TGTCAGAGGGCTCTTCTGAA | 0 | 2916 |
| 500912 | 12247 | 12266 | GCAGGTGTCAGAGGGCTCTT | 60 | 2917 |
| 500913 | 12285 | 12304 | TCTCATGCTAGGTCCTGTGC | 80 | 2918 |
| 500914 | 12392 | 12411 | CTCTGCTACATCAAAACTTG | 25 | 2919 |
| 500915 | 12397 | 12416 | GACTCCTCTGCTACATCAAA | 38 | 2920 |
| 500916 | 12402 | 12421 | GAAAGGACTCCTCTGCTACA | 23 | 2921 |
| 413433 | 32431 | 32450 | GCCTGGACAAGTCCTGCCCA | 75 | 425 |

TABLE 43

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501824 | 27442 | 27461 | TTGGGTCTGATCAATTATTA | 14 | 2922 |
| 501825 | 27447 | 27466 | TGTGGTTGGGTCTGATCAAT | 50 | 2923 |
| 501826 | 27458 | 27477 | GGTTTCTGGGCTGTGGTTGG | 20 | 2924 |
| 501827 | 27469 | 27488 | GATGCTGGGCCGGTTTCTGG | 40 | 2925 |
| 501828 | 27551 | 27570 | CAGGAGATCTGCCTGTCCAA | 48 | 2926 |
| 501829 | 27556 | 27575 | TAGCTCAGGAGATCTGCCTG | 32 | 2927 |
| 501830 | 27561 | 27580 | AGCAGTAGCTCAGGAGATCT | 50 | 2928 |
| 501831 | 27566 | 27585 | TAATTAGCAGTAGCTCAGGA | 65 | 2929 |
| 501832 | 27613 | 27632 | AGGTTTGAGAGGCAGAGGGA | 6 | 2930 |
| 501833 | 27618 | 27637 | CCAGCAGGTTTGAGAGGCAG | 29 | 2931 |
| 501834 | 27623 | 27642 | TTCTGCCAGCAGGTTTGAGA | 40 | 2932 |
| 501835 | 27628 | 27647 | TGAGCTTCTGCCAGCAGGTT | 64 | 2933 |
| 501836 | 27633 | 27652 | CCAGGTGAGCTTCTGCCAGC | 43 | 2934 |
| 501837 | 27638 | 27657 | GCTTGCCAGGTGAGCTTCTG | 61 | 2935 |
| 501838 | 27643 | 27662 | TCTTTGCTTGCCAGGTGAGC | 67 | 2936 |
| 501839 | 27673 | 27692 | TCCAGGGAGAGACCAACAGG | 7 | 2937 |
| 501840 | 27678 | 27697 | TCTGGTCCAGGGAGAGACCA | 0 | 2938 |
| 501841 | 27683 | 27702 | AAATCTCTGGTCCAGGGAGA | 26 | 2939 |
| 501842 | 27688 | 27707 | GTGAAAAATCTCTGGTCCAG | 12 | 2940 |
| 501843 | 27693 | 27712 | AAGTGGTGAAAAATCTCTGG | 5 | 2941 |
| 501844 | 27698 | 27717 | GCACAAAGTGGTGAAAAATC | 41 | 2942 |
| 501845 | 27703 | 27722 | CCATGGCACAAAGTGGTGAA | 41 | 2943 |
| 501846 | 27708 | 27727 | GGGTTCCATGGCACAAAGTG | 1 | 2944 |
| 501847 | 27761 | 27780 | ATTAAATACTCTAAAACACT | 0 | 2945 |
| 501848 | 27766 | 27785 | CTTGTATTAAATACTCTAAA | 5 | 2946 |
| 501849 | 27771 | 27790 | TGCACCTTGTATTAAATACT | 77 | 2947 |
| 501850 | 27776 | 27795 | TCCAATGCACCTTGTATTAA | 79 | 2948 |
| 501851 | 27781 | 27800 | TGAAATCCAATGCACCTTGT | 69 | 2949 |
| 501852 | 27786 | 27805 | TCCTTTGAAATCCAATGCAC | 76 | 2950 |
| 501853 | 27791 | 27810 | TAGTTTCCTTTGAAATCCAA | 64 | 2951 |
| 501854 | 27849 | 27868 | TGTTACTACATGTCTAATCA | 32 | 2952 |
| 501855 | 27854 | 27873 | GCACCTGTTACTACATGTCT | 87 | 2953 |
| 501856 | 27859 | 27878 | AAAGGCACCTGTTACTACA | 57 | 2954 |
| 501857 | 27864 | 27883 | TAATAAAAGGCACCTGTTA | 32 | 2955 |
| 501858 | 27992 | 28011 | AAATAACAAAGGTATTTCA | 1 | 2956 |
| 501859 | 27997 | 28016 | CAAATAAATAACAAAGGTAT | 14 | 2957 |

TABLE 43-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501860 | 28002 | 28021 | TGACACAAATAAATAACAAA | 18 | 2958 |
| 501861 | 28026 | 28045 | TCACAGAATTATCAGCAGTA | 92 | 2959 |
| 501862 | 28031 | 28050 | ATAAATCACAGAATTATCAG | 0 | 2960 |
| 501863 | 28054 | 28073 | CATTTCCTTCACTTACCAAT | 41 | 2961 |
| 501864 | 28078 | 28097 | CACTTATCTCTTATGGAAAT | 47 | 2962 |
| 501865 | 28083 | 28102 | ATTTTCACTTATCTCTTATG | 35 | 2963 |
| 501866 | 28088 | 28107 | TCTAAATTTTCACTTATCTC | 48 | 2964 |
| 501867 | 28093 | 28112 | TGACATCTAAATTTTCACTT | 63 | 2965 |
| 501868 | 28098 | 28117 | ACAAATGACATCTAAATTTT | 0 | 2966 |
| 501869 | 28103 | 28122 | GGGAAACAAATGACATCTAA | 58 | 2967 |
| 501870 | 28127 | 28146 | ACACAATATCCATGGACTTG | 59 | 2968 |
| 501871 | 28132 | 28151 | CTGACACACAATATCCATGG | 75 | 2969 |
| 501872 | 28185 | 28204 | ATTTCCTTACAGGGTATTGG | 53 | 2970 |
| 501873 | 28210 | 28229 | GGCCAAGCCCCATTCCTAAG | 7 | 2971 |
| 501874 | 28215 | 28234 | TTGCTGGCCAAGCCCCATTC | 0 | 2972 |
| 501875 | 28220 | 28239 | GCCACTTGCTGGCCAAGCCC | 22 | 2973 |
| 501876 | 28269 | 28288 | GGTGAAGAGCATGGACTCTG | 41 | 2974 |
| 501877 | 28293 | 28312 | GCAGGGAAGGCAGCAGTGTG | 39 | 2975 |
| 501878 | 28298 | 28317 | CAATGGCAGGGAAGGCAGCA | 55 | 2976 |
| 501879 | 28358 | 28377 | ACTTGTGATACAAAATTCTG | 41 | 2977 |
| 501880 | 28363 | 28382 | AAGACACTTGTGATACAAAA | 66 | 2978 |
| 501881 | 28454 | 28473 | AAGCTTAGAAGGCCCTGCTT | 44 | 2979 |
| 501882 | 28459 | 28478 | ATGAGAAGCTTAGAAGGCCC | 41 | 2980 |
| 501883 | 28464 | 28483 | AGCTCATGAGAAGCTTAGAA | 74 | 2981 |
| 501884 | 28469 | 28488 | TGCTGAGCTCATGAGAAGCT | 82 | 2982 |
| 501885 | 28474 | 28493 | ACTGTTGCTGAGCTCATGAG | 37 | 2983 |
| 501886 | 28479 | 28498 | AAACCACTGTTGCTGAGCTC | 78 | 2984 |
| 501887 | 28484 | 28503 | AGTAAAAACCACTGTTGCTG | 60 | 2985 |
| 501888 | 28489 | 28508 | GCTGCAGTAAAAACCACTGT | 66 | 2986 |
| 501889 | 28515 | 28534 | CTGGTTCCATGCTCTTAGGT | 63 | 2987 |
| 501890 | 28520 | 28539 | AGGCTCTGGTTCCATGCTCT | 71 | 2988 |
| 501891 | 28525 | 28544 | ACAACAGGCTCTGGTTCCAT | 38 | 2989 |
| 501892 | 28530 | 28549 | TCTGAACAACAGGCTCTGGT | 19 | 2990 |
| 501893 | 28535 | 28554 | TGTCCTCTGAACAACAGGCT | 52 | 2991 |
| 501894 | 28540 | 28559 | ATCCTTGTCCTCTGAACAAC | 36 | 2992 |

TABLE 43-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501895 | 28545 | 28564 | GCCTAATCCTTGTCCTCTGA | 54 | 2993 |
| 501896 | 28550 | 28569 | TCAGAGCCTAATCCTTGTCC | 53 | 2994 |
| 501897 | 28555 | 28574 | CTTTCTCAGAGCCTAATCCT | 39 | 2995 |
| 501898 | 28560 | 28579 | CCTTCCTTTCTCAGAGCCTA | 50 | 2996 |
| 501899 | 28565 | 28584 | AATGACCTTCCTTTCTCAGA | 19 | 2997 |
| 501900 | 28570 | 28589 | CACCAAATGACCTTCCTTTC | 66 | 2998 |
| 413433 | 32431 | 32450 | GCCTGGACAAGTCCTGCCCA | 79 | 425 |

TABLE 44

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501901 | 28575 | 28594 | AAATCCACCAAATGACCTTC | 42 | 2999 |
| 501902 | 28580 | 28599 | GAACTAAATCCACCAAATGA | 13 | 3000 |
| 501903 | 28585 | 28604 | AGGATGAACTAAATCCACCA | 65 | 3001 |
| 501904 | 28590 | 28609 | GCAAAGGATGAACTAAATC | 4 | 3002 |
| 501905 | 28595 | 28614 | GAAGAGCAAAAGGATGAACT | 0 | 3003 |
| 501906 | 28600 | 28619 | CACAGGAAGAGCAAAAGGAT | 0 | 3004 |
| 501907 | 28605 | 28624 | CCAAACACAGGAAGAGCAAA | 0 | 3005 |
| 501908 | 28610 | 28629 | AGAAACCAAACACAGGAAGA | 33 | 3006 |
| 501909 | 28615 | 28634 | GCCCCAGAAACCAAACACAG | 20 | 3007 |
| 501910 | 28620 | 28639 | CTCCAGCCCCAGAAACCAAA | 45 | 3008 |
| 501911 | 28625 | 28644 | AATCTCTCCAGCCCCAGAAA | 36 | 3009 |
| 501912 | 28787 | 28806 | CCTGGCCTTTCTCAGCTGGG | 25 | 3010 |
| 501913 | 28792 | 28811 | TCTAGCCTGGCCTTTCTCAG | 0 | 3011 |
| 501914 | 28797 | 28816 | TGAATTCTAGCCTGGCCTTT | 44 | 3012 |
| 501915 | 28802 | 28821 | GAGACTGAATTCTAGCCTGG | 48 | 3013 |
| 501916 | 28807 | 28826 | ATCCAGAGACTGAATTCTAG | 71 | 3014 |
| 501917 | 28829 | 28848 | AGAAGAAGAGGCCTGATGGG | 29 | 3015 |
| 501918 | 28834 | 28853 | GATGGAGAAGAAGAGGCCTG | 59 | 3016 |
| 501919 | 28839 | 28858 | GCCTGGATGGAGAAGAAGAG | 0 | 3017 |
| 501920 | 28844 | 28863 | AGGCAGCCTGGATGGAGAAG | 5 | 3018 |
| 501921 | 28849 | 28868 | TGCTGAGGCAGCCTGGATGG | 26 | 3019 |
| 501922 | 28854 | 28873 | TCTGCTGCTGAGGCAGCCTG | 12 | 3020 |

TABLE 44-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501923 | 28859 | 28878 | CTTACTCTGCTGCTGAGGCA | 47 | 3021 |
| 501924 | 28864 | 28883 | TTGTCCTTACTCTGCTGCTG | 55 | 3022 |
| 501925 | 28901 | 28920 | GGCTGGTCTCTCTGGGAAGG | 25 | 3023 |
| 501926 | 28906 | 28925 | TAGAGGGCTGGTCTCTCTGG | 40 | 3024 |
| 501927 | 28911 | 28930 | CTGCTTAGAGGGCTGGTCTC | 40 | 3025 |
| 501928 | 28916 | 28935 | CCCCACTGCTTAGAGGGCTG | 34 | 3026 |
| 501929 | 28921 | 28940 | CCAGGCCCCACTGCTTAGAG | 26 | 3027 |
| 501930 | 28926 | 28945 | GAGCTCCAGGCCCCACTGCT | 7 | 3028 |
| 501931 | 28986 | 29005 | GGAAACCTAGCTTCCAGAAA | 53 | 3029 |
| 501932 | 29010 | 29029 | TTTAGGCTATGGTCTGAGCA | 78 | 3030 |
| 501933 | 29015 | 29034 | TGAGGTTTAGGCTATGGTCT | 68 | 3031 |
| 501934 | 29044 | 29063 | GATGCTCCAGGTGGGCCAGA | 68 | 3032 |
| 501935 | 29049 | 29068 | AGGTGGATGCTCCAGGTGGG | 0 | 3033 |
| 501936 | 29054 | 29073 | CCTCTAGGTGGATGCTCCAG | 18 | 3034 |
| 501937 | 29059 | 29078 | GGCATCCTCTAGGTGGATGC | 22 | 3035 |
| 501938 | 29064 | 29083 | CTAGTGGCATCCTCTAGGTG | 50 | 3036 |
| 501939 | 29069 | 29088 | CTCCTCTAGTGGCATCCTCT | 33 | 3037 |
| 501940 | 29074 | 29093 | CCAGGCTCCTCTAGTGGCAT | 55 | 3038 |
| 501941 | 29079 | 29098 | GGCATCCAGGCTCCTCTAGT | 53 | 3039 |
| 501942 | 29103 | 29122 | GACTCTAGCCCCCCAGACTC | 29 | 3040 |
| 501943 | 29139 | 29158 | TCTGCCTGATTCCCTTTCTT | 30 | 3041 |
| 501944 | 29144 | 29163 | AGCAGTCTGCCTGATTCCCT | 81 | 3042 |
| 501945 | 29149 | 29168 | TGTTCAGCAGTCTGCCTGAT | 50 | 3043 |
| 501946 | 29154 | 29173 | CTTACTGTTCAGCAGTCTGC | 70 | 3044 |
| 501947 | 29159 | 29178 | TCATACTTACTGTTCAGCAG | 65 | 3045 |
| 501948 | 29164 | 29183 | CAAAGTCATACTTACTGTTC | 29 | 3046 |
| 501949 | 29169 | 29188 | GCCTACAAAGTCATACTTAC | 17 | 3047 |
| 501950 | 29193 | 29212 | GGTGAATAGCTATGTCTAAA | 80 | 3048 |
| 501951 | 29198 | 29217 | AGCTTGGTGAATAGCTATGT | 76 | 3049 |
| 501952 | 29222 | 29241 | AGCAAACTGTGAAAAGCTTA | 59 | 3050 |
| 501953 | 29227 | 29246 | TTAAAAGCAAACTGTGAAAA | 2 | 3051 |
| 501954 | 29232 | 29251 | GCCTGTTAAAAGCAAACTGT | 48 | 3052 |
| 501955 | 29237 | 29256 | CAAGAGCCTGTTAAAAGCAA | 12 | 3053 |
| 501956 | 29242 | 29261 | GCCTACAAGAGCCTGTTAAA | 30 | 3054 |
| 501957 | 29247 | 29266 | GTGCAGCCTACAAGAGCCTG | 69 | 3055 |

TABLE 44-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501958 | 29252 | 29271 | AGCATGTGCAGCCTACAAGA | 57 | 3056 |
| 501959 | 29257 | 29276 | AGGGAAGCATGTGCAGCCTA | 76 | 3057 |
| 501960 | 29262 | 29281 | TTTCTAGGGAAGCATGTGCA | 76 | 3058 |
| 501961 | 29267 | 29286 | ACAAGTTTCTAGGGAAGCAT | 40 | 3059 |
| 501962 | 29272 | 29291 | GGAAGACAAGTTTCTAGGGA | 52 | 3060 |
| 501963 | 29277 | 29296 | AGAAGGGAAGACAAGTTTCT | 30 | 3061 |
| 501964 | 29282 | 29301 | ATCGCAGAAGGGAAGACAAG | 28 | 3062 |
| 501965 | 29327 | 29346 | AGTGACGAGATGTCCAATTT | 59 | 3063 |
| 501966 | 29361 | 29380 | ACAACTCTCTTGTTGGGAGG | 71 | 3064 |
| 501967 | 29366 | 29385 | AGGGTACAACTCTCTTGTTG | 59 | 3065 |
| 501968 | 29371 | 29390 | AAAACAGGGTACAACTCTCT | 73 | 3066 |
| 501969 | 29376 | 29395 | AGCTAAAAACAGGGTACAAC | 13 | 3067 |
| 501970 | 29383 | 29402 | CCAGGGTAGCTAAAAACAGG | 3 | 3068 |
| 501971 | 29388 | 29407 | TCTCCCCAGGGTAGCTAAAA | 0 | 3069 |
| 501972 | 29393 | 29412 | CAGCCTCTCCCCAGGGTAGC | 33 | 3070 |
| 501973 | 29417 | 29436 | TAGCCCTGTTCTAGACTCCT | 36 | 3071 |
| 501974 | 29440 | 29459 | TAGCCCCTTGTTGCCCCCCA | 43 | 3072 |
| 501975 | 29445 | 29464 | AATGGTAGCCCCTTGTTGCC | 11 | 3073 |
| 501976 | 29450 | 29469 | AGGGAAATGGTAGCCCCTTG | 63 | 3074 |
| 501977 | 29475 | 29494 | GTAGACTCTCCATGAGCCTA | 60 | 3075 |
| 413433 | 32431 | 32450 | GCCTGGACAAGTCCTGCCCA | 77 | 425 |

TABLE 45

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501978 | 30937 | 30956 | GGGCCCACAAACCCTGAGAA | 20 | 3076 |
| 501979 | 30962 | 30981 | AGGCACACCCAGGGCCATGG | 68 | 3077 |
| 501980 | 30967 | 30986 | AAGCTAGGCACACCCAGGGC | 48 | 3078 |
| 501981 | 30972 | 30991 | GCACTAAGCTAGGCACACCC | 77 | 3079 |
| 501982 | 30977 | 30996 | CTGTGGCACTAAGCTAGGCA | 78 | 3080 |
| 501983 | 30982 | 31001 | GTTTACTGTGGCACTAAGCT | 80 | 3081 |
| 501984 | 30987 | 31006 | TGAGTGTTTACTGTGGCACT | 56 | 3082 |
| 501985 | 31026 | 31045 | ACTGGGCTTCATCTCCCCTC | 0 | 3083 |

TABLE 45-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 501986 | 31031 | 31050 | GTCCTACTGGGCTTCATCTC | 28 | 3084 |
| 501987 | 31074 | 31093 | GGCACTGCAGGCCACTCCTG | 41 | 3085 |
| 501988 | 31185 | 31204 | AAGGGAGGCCTTGCACTTAC | 26 | 3086 |
| 501989 | 31236 | 31255 | GCCCTTCAGCTTGTGCAGGG | 36 | 3087 |
| 501990 | 31241 | 31260 | ATGAGGCCCTTCAGCTTGTG | 57 | 3088 |
| 501991 | 31246 | 31265 | TCAGGATGAGGCCCTTCAGC | 67 | 3089 |
| 501992 | 31251 | 31270 | AGCACTCAGGATGAGGCCCT | 50 | 3090 |
| 501993 | 31274 | 31293 | ACAAAGTGGGTGTTAAAAGA | 22 | 3091 |
| 501994 | 31279 | 31298 | TTTTCACAAAGTGGGTGTTA | 40 | 3092 |
| 501995 | 31315 | 31334 | GCTTTTAACCTCCCCCCAAA | 6 | 3093 |
| 501996 | 31366 | 31385 | CCTCGACTGAGTGTGAACTC | 66 | 3094 |
| 501997 | 31371 | 31390 | CAAACCCTCGACTGAGTGTG | 46 | 3095 |
| 501998 | 31376 | 31395 | TTATGCAAACCCTCGACTGA | 24 | 3096 |
| 501999 | 31490 | 31509 | ACATTTGGGCAAGGCAGACA | 14 | 3097 |
| 502000 | 31525 | 31544 | AGGGAATAAAATACAGAGTT | 0 | 3098 |
| 502001 | 31530 | 31549 | CTTCCAGGGAATAAAATACA | 0 | 3099 |
| 502002 | 31535 | 31554 | GCCACCTTCCAGGGAATAAA | 0 | 3100 |
| 502003 | 31540 | 31559 | CTCCTGCCACCTTCCAGGGA | 0 | 3101 |
| 502004 | 31545 | 31564 | GTGACCTCCTGCCACCTTCC | 54 | 3102 |
| 502005 | 31606 | 31625 | TTTACCTGGATGGGAAAGTA | 0 | 3103 |
| 502006 | 31612 | 31631 | CAGCACTTTACCTGGATGGG | 2 | 3104 |
| 502007 | 31617 | 31636 | ACTCACAGCACTTTACCTGG | 0 | 3105 |
| 502008 | 31622 | 31641 | ACAACACTCACAGCACTTTA | 1 | 3106 |
| 502009 | 31688 | 31707 | ACTTGCTTCCCTGTGGGTGG | 0 | 3107 |
| 502010 | 31693 | 31712 | TCTAAACTTGCTTCCCTGTG | 16 | 3108 |
| 502011 | 31698 | 31717 | CTTGGTCTAAACTTGCTTCC | 60 | 3109 |
| 502012 | 31703 | 31722 | ACCAACTTGGTCTAAACTTG | 57 | 3110 |
| 502013 | 31768 | 31787 | GGATACTCAGAAGAGCAGTG | 79 | 3111 |
| 502014 | 31792 | 31811 | CCTCAGGGCTGGCCCAAAGA | 61 | 3112 |
| 502015 | 31797 | 31816 | CAGGACCTCAGGGCTGGCCC | 74 | 3113 |
| 502016 | 31802 | 31821 | CCTGTCAGGACCTCAGGGCT | 40 | 3114 |
| 502017 | 31807 | 31826 | ATTTCCCTGTCAGGACCTCA | 46 | 3115 |
| 502018 | 31828 | 31847 | TGAAAGCCAAACTGAGCCAC | 55 | 3116 |
| 502019 | 31866 | 31885 | AGCTTGCAGACCAGGCAGGG | 60 | 3117 |
| 502020 | 31871 | 31890 | AGCCCAGCTTGCAGACCAGG | 55 | 3118 |

TABLE 45-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 502021 | 31876 | 31895 | TCACCAGCCCAGCTTGCAGA | 30 | 3119 |
| 502022 | 31881 | 31900 | GTGCCTCACCAGCCCAGCTT | 49 | 3120 |
| 502023 | 31904 | 31923 | ACATGCATCAGGGCCAGATG | 35 | 3121 |
| 502024 | 31932 | 31951 | AGTTATCCTCAATTCACCAG | 66 | 3122 |
| 502025 | 31937 | 31956 | GCCAGAGTTATCCTCAATTC | 76 | 3123 |
| 502026 | 31942 | 31961 | ATCCTGCCAGAGTTATCCTC | 71 | 3124 |
| 502027 | 31947 | 31966 | TCAGGATCCTGCCAGAGTTA | 63 | 3125 |
| 502028 | 31952 | 31971 | AACCTTCAGGATCCTGCCAG | 60 | 3126 |
| 502029 | 31957 | 31976 | GGGAAAACCTTCAGGATCCT | 51 | 3127 |
| 502030 | 31975 | 31994 | ACAGGTCTTTCCCCTGTGGG | 31 | 3128 |
| 502031 | 31980 | 31999 | GCCAGACAGGTCTTTCCCCT | 65 | 3129 |
| 502032 | 32052 | 32071 | CTTCAGCACCCCTACCTTCT | 45 | 3130 |
| 502033 | 32057 | 32076 | CCACTCTTCAGCACCCCTAC | 53 | 3131 |
| 502034 | 32062 | 32081 | TGCCTCCACTCTTCAGCACC | 60 | 3132 |
| 502035 | 32110 | 32129 | ATATACACCACCCTGCACCC | 30 | 3133 |
| 502036 | 32115 | 32134 | AGCAAATATACACCACCCTG | 67 | 3134 |
| 502037 | 32120 | 32139 | ACAACAGCAAATATACACCA | 73 | 3135 |
| 502038 | 32125 | 32144 | GACTCACAACAGCAAATATA | 68 | 3136 |
| 502039 | 32130 | 32149 | TCACTGACTCACAACAGCAA | 60 | 3137 |
| 502040 | 32135 | 32154 | CTCAGTCACTGACTCACAAC | 83 | 3138 |
| 502041 | 32140 | 32159 | AGGATCTCAGTCACTGACTC | 68 | 3139 |
| 502042 | 32146 | 32165 | CACACCAGGATCTCAGTCAC | 61 | 3140 |
| 502043 | 32167 | 32186 | CCAGCCACTGCCCCCAGGCA | 38 | 3141 |
| 502044 | 32172 | 32191 | GTTACCCAGCCACTGCCCCC | 33 | 3142 |
| 502045 | 32177 | 32196 | GCAGGGTTACCCAGCCACTG | 76 | 3143 |
| 502046 | 32182 | 32201 | AGGATGCAGGGTTACCCAGC | 80 | 3144 |
| 502047 | 32187 | 32206 | AGTGAAGGATGCAGGGTTAC | 13 | 3145 |
| 502048 | 32192 | 32211 | AATGCAGTGAAGGATGCAGG | 52 | 3146 |
| 502049 | 32223 | 32242 | AGGAGCTGGCCCTGCCACCC | 48 | 3147 |
| 502050 | 32228 | 32247 | GCAGAAGGAGCTGGCCCTGC | 64 | 3148 |
| 502051 | 32233 | 32252 | GATGAGCAGAAGGAGCTGGC | 56 | 3149 |
| 502052 | 32238 | 32257 | CTAAGGATGAGCAGAAGGAG | 42 | 3150 |
| 502053 | 32243 | 32262 | TTAGGCTAAGGATGAGCAGA | 60 | 3151 |
| 502054 | 32248 | 32267 | TGGGCTTAGGCTAAGGATGA | 53 | 3152 |
| 413433 | 32431 | 32450 | GCCTGGACAAGTCCTGCCCA | 79 | 425 |

TABLE 46

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 413433 | 32431 | 32450 | GCCTGGACAAGTCCTGCCCA | 77 | 425 |
| 502055 | 33408 | 33427 | TCTTCATTACATGATTACTG | 66 | 3153 |
| 502056 | 33413 | 33432 | GCAGATCTTCATTACATGAT | 81 | 3154 |
| 502057 | 33449 | 33468 | ACCAGGAAGGGAGTAGGTGG | 0 | 3155 |
| 502058 | 33454 | 33473 | GTCCCACCAGGAAGGGAGTA | 0 | 3156 |
| 502059 | 33459 | 33478 | CCAGAGTCCCACCAGGAAGG | 0 | 3157 |
| 502060 | 33464 | 33483 | AAAGACCAGAGTCCCACCAG | 15 | 3158 |
| 502061 | 33489 | 33508 | GGGCCAGATGAGCTGTTCTG | 26 | 3159 |
| 502062 | 33513 | 33532 | GTGCCAACAGAAGGGATACA | 68 | 3160 |
| 502063 | 33518 | 33537 | CACCTGTGCCAACAGAAGGG | 36 | 3161 |
| 502064 | 33523 | 33542 | AACCCCACCTGTGCCAACAG | 53 | 3162 |
| 502065 | 33557 | 33576 | GGCTGGTGGTCTCGGTGGCT | 61 | 3163 |
| 502066 | 33562 | 33581 | CAGGTGGCTGGTGGTCTCGG | 38 | 3164 |
| 502067 | 33567 | 33586 | TCTTCCAGGTGGCTGGTGGT | 32 | 3165 |
| 502068 | 33572 | 33591 | GCTCCTCTTCCAGGTGGCTG | 61 | 3166 |
| 502069 | 33577 | 33596 | TGTCTGCTCCTCTTCCAGGT | 63 | 3167 |
| 502070 | 33582 | 33601 | GGCACTGTCTGCTCCTCTTC | 64 | 3168 |
| 502071 | 33636 | 33655 | TTCCTAGTCTCCTCTCCAAG | 24 | 3169 |
| 502072 | 33658 | 33677 | ATTCTAAGCTTAGAGAGAGT | 28 | 3170 |
| 502073 | 33663 | 33682 | AGGTGATTCTAAGCTTAGAG | 53 | 3171 |
| 502074 | 33668 | 33687 | TGGACAGGTGATTCTAAGCT | 66 | 3172 |
| 502075 | 33673 | 33692 | GCAGATGGACAGGTGATTCT | 72 | 3173 |
| 502076 | 33678 | 33697 | ATGAGGCAGATGGACAGGTG | 66 | 3174 |
| 502077 | 33683 | 33702 | GTGAAATGAGGCAGATGGAC | 52 | 3175 |
| 502078 | 33688 | 33707 | TATCAGTGAAATGAGGCAGA | 16 | 3176 |
| 502079 | 33693 | 33712 | AAGCCTATCAGTGAAATGAG | 8 | 3177 |
| 502080 | 33698 | 33717 | TCAGTAAGCCTATCAGTGAA | 0 | 3178 |
| 502081 | 33703 | 33722 | GTGCCTCAGTAAGCCTATCA | 56 | 3179 |
| 502082 | 33708 | 33727 | TCTCTGTGCCTCAGTAAGCC | 32 | 3180 |
| 502083 | 33729 | 33748 | TGACCTTGGGATAGTCCCTC | 84 | 3181 |
| 502084 | 33734 | 33753 | CTTTGTGACCTTGGGATAGT | 61 | 3182 |
| 502085 | 33740 | 33759 | CTTAAGCTTTGTGACCTTGG | 69 | 3183 |
| 502086 | 33745 | 33764 | TACTACTTAAGCTTTGTGAC | 59 | 3184 |
| 502087 | 33750 | 33769 | CCTGCTACTACTTAAGCTTT | 30 | 3185 |
| 502088 | 33755 | 33774 | CTAGTCCTGCTACTACTTAA | 43 | 3186 |
| 502089 | 33760 | 33779 | CTACACTAGTCCTGCTACTA | 16 | 3187 |

TABLE 46-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 502090 | 33765 | 33784 | GGTTCCTACACTAGTCCTGC | 59 | 3188 |
| 502091 | 33802 | 33821 | CAGGAGTAAGACCATGGGCC | 59 | 3189 |
| 502092 | 33807 | 33826 | TAACACAGGAGTAAGACCAT | 57 | 3190 |
| 502093 | 33812 | 33831 | GAAAGTAACACAGGAGTAAG | 45 | 3191 |
| 502094 | 33817 | 33836 | ATGGTGAAAGTAACACAGGA | 54 | 3192 |
| 502095 | 33846 | 33865 | TGCTTAAGTTTACACAGCAC | 66 | 3193 |
| 502096 | 33851 | 33870 | AGGCTTGCTTAAGTTTACAC | 62 | 3194 |
| 502097 | 33856 | 33875 | AGCAAAGGCTTGCTTAAGTT | 65 | 3195 |
| 502098 | 33861 | 33880 | AGAAGAGCAAAGGCTTGCTT | 79 | 3196 |
| 502099 | 33866 | 33885 | CCCACAGAAGAGCAAAGGCT | 80 | 3197 |
| 502100 | 33871 | 33890 | TCAGACCCACAGAAGAGCAA | 69 | 3198 |
| 502101 | 33893 | 33912 | AGCAGTGCATAGAGGAAAAA | 16 | 3199 |
| 502102 | 33898 | 33917 | ACCACAGCAGTGCATAGAGG | 60 | 3200 |
| 502103 | 33903 | 33922 | GTCCCACCACAGCAGTGCAT | 49 | 3201 |
| 502104 | 33908 | 33927 | GGCTTGTCCCACCACAGCAG | 42 | 3202 |
| 502105 | 33913 | 33932 | AGATAGGCTTGTCCCACCAC | 54 | 3203 |
| 502106 | 33918 | 33937 | TGCTCAGATAGGCTTGTCCC | 71 | 3204 |
| 502107 | 33958 | 33977 | CAAGTCACTCTTTATACCCT | 53 | 3205 |
| 502108 | 33963 | 33982 | CCTATCAAGTCACTCTTTAT | 18 | 3206 |
| 502109 | 33968 | 33987 | ACATTCCTATCAAGTCACTC | 58 | 3207 |
| 502110 | 34017 | 34036 | CCCAACACGATGCCCAGGCC | 70 | 3208 |
| 502111 | 34053 | 34072 | TCCTCTTGCTGCCTGTTTCC | 34 | 3209 |
| 502112 | 34058 | 34077 | TTGTGTCCTCTTGCTGCCTG | 59 | 3210 |
| 502113 | 34063 | 34082 | TGCTCTTGTGTCCTCTTGCT | 68 | 3211 |
| 502114 | 34098 | 34117 | AAGGATACCGCCAATGAAGG | 65 | 3212 |
| 502115 | 34155 | 34174 | TCATGTCACACTCCCCTCCC | 58 | 3213 |
| 502116 | 34179 | 34198 | CATCTGACCAGCTCTGATCT | 52 | 3214 |
| 502117 | 34184 | 34203 | GTAGGCATCTGACCAGCTCT | 68 | 3215 |
| 502118 | 34189 | 34208 | AGAATGTAGGCATCTGACCA | 57 | 3216 |
| 502119 | 34211 | 34230 | TGCCCTTGCTGTAGGACCCA | 84 | 3217 |
| 502120 | 34216 | 34235 | GTCAATGCCCTTGCTGTAGG | 70 | 3218 |
| 502121 | 34221 | 34240 | TGCAAGTCAATGCCCTTGCT | 44 | 3219 |
| 502122 | 34226 | 34245 | CACAGTGCAAGTCAATGCCC | 62 | 3220 |
| 502123 | 34231 | 34250 | TGGGACACAGTGCAAGTCAA | 55 | 3221 |
| 502124 | 34267 | 34286 | AGGCTCTGATGGGACATTTG | 65 | 3222 |

TABLE 46-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
| --- | --- | --- | --- | --- | --- |
| 502125 | 34301 | 34320 | CAGGTGGCTCTTTAAATCAT | 59 | 3223 |
| 502126 | 34306 | 34325 | GGCCCCAGGTGGCTCTTTAA | 32 | 3224 |
| 502127 | 34312 | 34331 | CCAGTGGGCCCCAGGTGGCT | 63 | 3225 |
| 502128 | 34317 | 34336 | GTCACCCAGTGGGCCCCAGG | 46 | 3226 |
| 502129 | 34340 | 34359 | CCTGGGCTGCTGGATGAAGA | 0 | 3227 |
| 502130 | 34345 | 34364 | TTTTCCCTGGGCTGCTGGAT | 28 | 3228 |
| 502131 | 34350 | 34369 | TGCACTTTTCCCTGGGCTGC | 70 | 3229 |

TABLE 47

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
| --- | --- | --- | --- | --- | --- |
| 413433 | 32431 | 32450 | GCCTGGACAAGTCCTGCCCA | 78 | 425 |
| 502132 | 34391 | 34410 | TCACAGCAAATTATCCTGCA | 49 | 3230 |
| 502133 | 34396 | 34415 | GGAGGTCACAGCAAATTATC | 41 | 3231 |
| 502134 | 34401 | 34420 | CCTGTGGAGGTCACAGCAAA | 52 | 3232 |
| 502135 | 34460 | 34479 | TAAGCCATTCCTTGGATGAC | 72 | 3233 |
| 502136 | 34465 | 34484 | AGGTCTAAGCCATTCCTTGG | 58 | 3234 |
| 502137 | 34470 | 34489 | CTGAAAGGTCTAAGCCATTC | 59 | 3235 |
| 502138 | 34553 | 34572 | TTTGTCCCCTTCCTATGGCT | 49 | 3236 |
| 502139 | 34605 | 34624 | CAGGCCTGGGATAGTTACCC | 8 | 3237 |
| 502140 | 34610 | 34629 | ATGGCCAGGCCTGGGATAGT | 33 | 3238 |
| 502141 | 34615 | 34634 | AGCTGATGGCCAGGCCTGGG | 7 | 3239 |
| 502142 | 34620 | 34639 | TCCTGAGCTGATGGCCAGGC | 40 | 3240 |
| 502143 | 34625 | 34644 | CTTGCTCCTGAGCTGATGGC | 20 | 3241 |
| 502144 | 34630 | 34649 | GGAAACTTGCTCCTGAGCTG | 62 | 3242 |
| 502145 | 34635 | 34654 | AACTTGGAAACTTGCTCCTG | 52 | 3243 |
| 502146 | 34640 | 34659 | TGGGAAACTTGGAAACTTGC | 66 | 3244 |
| 502147 | 34676 | 34695 | GGCATTGAGGGAAGAGCTGG | 42 | 3245 |
| 502148 | 34681 | 34700 | AGGCAGGCATTGAGGGAAGA | 53 | 3246 |
| 502149 | 34686 | 34705 | AAGGCAGGCAGGCATTGAGG | 62 | 3247 |
| 502150 | 34691 | 34710 | TGAAAAGGCAGGCAGGCAT | 63 | 3248 |
| 502151 | 34696 | 34715 | TTTGATGAAAAGGCAGGCA | 49 | 3249 |
| 502152 | 34701 | 34720 | CTAGTTTTGATGAAAAGGC | 53 | 3250 |

TABLE 47-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 502153 | 34706 | 34725 | TTGTGCTAGTTTTGATGAAA | 41 | 3251 |
| 502154 | 34739 | 34758 | TAGCTCTCAGTGAAGCTGGA | 83 | 3252 |
| 502155 | 34826 | 34845 | GAGCAGATCTCAAAATCTCG | 70 | 3253 |
| 502156 | 34868 | 34887 | ACAGCAGCAGTCTAATCCAT | 73 | 3254 |
| 502157 | 34873 | 34892 | GGGAAACAGCAGCAGTCTAA | 49 | 3255 |
| 502158 | 34878 | 34897 | TAAATGGGAAACAGCAGCAG | 62 | 3256 |
| 502159 | 34883 | 34902 | CCAAATAAATGGGAAACAGC | 15 | 3257 |
| 502160 | 34888 | 34907 | ACTCCCCAAATAAATGGGAA | 13 | 3258 |
| 502161 | 34893 | 34912 | CAGCTACTCCCCAAATAAAT | 0 | 3259 |
| 502162 | 34898 | 34917 | ACTCTCAGCTACTCCCCAAA | 56 | 3260 |
| 502163 | 34903 | 34922 | AACCAACTCTCAGCTACTCC | 76 | 3261 |
| 502164 | 34931 | 34950 | CAAACAGATTAAAGTTGCTC | 80 | 3262 |
| 502165 | 35006 | 35025 | AATGTGAGCAAGACTCCCTC | 58 | 3263 |
| 502166 | 35167 | 35186 | TTGGGAGCCTCCTGGCAGAG | 0 | 3264 |
| 502167 | 35192 | 35211 | GCCCAGGTTTTCTGTGACTC | 65 | 3265 |
| 502168 | 35197 | 35216 | CAAGAGCCCAGGTTTTCTGT | 53 | 3266 |
| 502169 | 35220 | 35239 | GTCACTGGCCACCAGCAGAA | 44 | 3267 |
| 502170 | 35225 | 35244 | GCAGAGTCACTGGCCACCAG | 59 | 3268 |
| 502171 | 35230 | 35249 | TGGAAGCAGAGTCACTGGCC | 48 | 3269 |
| 502172 | 35263 | 35282 | TGCAAAGTGCCCCTTCCCTG | 67 | 3270 |
| 502173 | 35268 | 35287 | AGTGCTGCAAAGTGCCCCTT | 61 | 3271 |
| 502174 | 35273 | 35292 | ACCTGAGTGCTGCAAAGTGC | 61 | 3272 |
| 502175 | 35278 | 35297 | CTCCCACCTGAGTGCTGCAA | 83 | 3273 |
| 502176 | 35283 | 35302 | TGACACTCCCACCTGAGTGC | 60 | 3274 |
| 502177 | 35288 | 35307 | ATCAATGACACTCCCACCTG | 59 | 3275 |
| 502178 | 35318 | 35337 | TTTTGGCTGCCCTGCCTCAA | 36 | 3276 |
| 502179 | 35323 | 35342 | GGTCTTTTTGGCTGCCCTGC | 82 | 3277 |
| 502180 | 35345 | 35364 | GATAACAAGGAATGAACACG | 8 | 3278 |
| 502181 | 35350 | 35369 | TCCTGGATAACAAGGAATGA | 36 | 3279 |
| 502182 | 35356 | 35375 | TACAATTCCTGGATAACAAG | 0 | 3280 |
| 502183 | 35361 | 35380 | AGAAATACAATTCCTGGATA | 9 | 3281 |
| 502184 | 35366 | 35385 | CTTCTAGAAATACAATTCCT | 37 | 3282 |
| 502185 | 35371 | 35390 | ACAAACTTCTAGAAATACAA | 0 | 3283 |
| 502186 | 35376 | 35395 | GTGAAACAAACTTCTAGAAA | 62 | 3284 |
| 502187 | 35401 | 35420 | TTTGTCCACATATCTGATTG | 40 | 3285 |

TABLE 47-continued

Inhibition of DGAT2 mRNA by
5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 502188 | 35406 | 35425 | TTATCTTTGTCCACATATCT | 44 | 3286 |
| 502189 | 35411 | 35430 | ATACCTTATCTTTGTCCACA | 81 | 3287 |
| 502190 | 35416 | 35435 | AATAAATACCTTATCTTTGT | 0 | 3288 |
| 502191 | 35421 | 35440 | GCTTCAATAAATACCTTATC | 88 | 3289 |
| 502192 | 35426 | 35445 | GTAATGCTTCAATAAATACC | 67 | 3290 |
| 502193 | 35431 | 35450 | TAGAAGTAATGCTTCAATAA | 0 | 3291 |
| 502194 | 35436 | 35455 | CCTCTTAGAAGTAATGCTTC | 75 | 3292 |
| 502195 | 35441 | 35460 | ATTTCCCTCTTAGAAGTAAT | 30 | 3293 |
| 502196 | 35446 | 35465 | CCAAAATTTCCCTCTTAGAA | 39 | 3294 |
| 502197 | 35519 | 35538 | TATTCTACAGCACAGCTCTC | 24 | 3295 |
| 502198 | 35560 | 35579 | TCAAAATCCCTCAGTTCCAT | 25 | 3296 |
| 502199 | 35565 | 35584 | CCTTATCAAAATCCCTCAGT | 53 | 3297 |
| 502200 | 35570 | 35589 | TCTGTCCTTATCAAAATCCC | 23 | 3298 |
| 502201 | 35575 | 35594 | AGCTATCTGTCCTTATCAAA | 8 | 3299 |
| 502202 | 35607 | 35626 | ATCATTTTTATATCATTTTC | 0 | 3300 |
| 502203 | 35612 | 35631 | TTGATATCATTTTTATATCA | 0 | 3301 |
| 502204 | 35617 | 35636 | ATGGGTTGATATCATTTTTA | 61 | 3302 |
| 502205 | 35622 | 35641 | GTTATATGGGTTGATATCAT | 48 | 3303 |
| 502206 | 35627 | 35646 | TTGAGGTTATATGGGTTGAT | 68 | 3304 |
| 502207 | 35632 | 35651 | CAAAATTGAGGTTATATGGG | 19 | 3305 |
| 502208 | 35656 | 35675 | ATACATGCTCTTTTTCAAAA | 45 | 3306 |

TABLE 48

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 413433 | 32431 | 32450 | GCCTGGACAAGTCCTGCCCA | 72 | 77 | 425 |
| 502209 | 37525 | 37544 | CATCTCCCAATGCAGGCCCA | 37 | 34 | 3307 |
| 502210 | 37555 | 37574 | GCCCTGACCCACCATGTCTG | 0 | 27 | 3308 |
| 502211 | 37560 | 37579 | CCTCAGCCCTGACCCACCAT | 19 | 51 | 3309 |
| 502212 | 37565 | 37584 | CTCCTCCTCAGCCCTGACCC | 0 | 8 | 3310 |
| 502213 | 37570 | 37589 | CAGCTCTCCTCCTCAGCCCT | 20 | 33 | 3311 |
| 502214 | 37575 | 37594 | ATGGACAGCTCTCCTCCTCA | 31 | 46 | 3312 |
| 502215 | 37580 | 37599 | ACCATATGGACAGCTCTCCT | 57 | 68 | 3313 |

TABLE 48-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 502216 | 37695 | 37714 | GTGCCATGGACAACAATCAG | 0 | 0 | 3314 |
| 502217 | 37700 | 37719 | TTACAGTGCCATGGACAACA | 0 | 23 | 3315 |
| 502218 | 37705 | 37724 | GACAATTACAGTGCCATGGA | 15 | 7 | 3316 |
| 502219 | 37740 | 37759 | AATGCATCAGTCTGGTGGGA | 53 | 59 | 3317 |
| 502220 | 37745 | 37764 | ATCCCAATGCATCAGTCTGG | 66 | 73 | 3318 |
| 502221 | 37804 | 37823 | TGCATTTGGCAAACATTCCC | 36 | 50 | 3319 |
| 502222 | 37809 | 37828 | ACTCATGCATTTGGCAAACA | 42 | 0 | 3320 |
| 502223 | 37814 | 37833 | TGGGAACTCATGCATTTGGC | 62 | 65 | 3321 |
| 502224 | 37819 | 37838 | TGTTTTGGGAACTCATGCAT | 3 | 25 | 3322 |
| 502225 | 37824 | 37843 | AAGGTTGTTTTGGGAACTCA | 44 | 42 | 3323 |
| 502226 | 37829 | 37848 | GATACAAGGTTGTTTTGGGA | 29 | 44 | 3324 |
| 502227 | 37834 | 37853 | CTAATGATACAAGGTTGTTT | 29 | 41 | 3325 |
| 502228 | 37839 | 37858 | TGCAGCTAATGATACAAGGT | 68 | 67 | 3326 |
| 502229 | 37844 | 37863 | TAAAATGCAGCTAATGATAC | 21 | 18 | 3327 |
| 502230 | 37849 | 37868 | ATCTGTAAAATGCAGCTAAT | 13 | 38 | 3328 |
| 502231 | 37854 | 37873 | TCCTCATCTGTAAAATGCAG | 48 | 43 | 3329 |
| 502232 | 37859 | 37878 | CAGTTTCCTCATCTGTAAAA | 8 | 19 | 3330 |
| 502233 | 37864 | 37883 | AGCCTCAGTTTCCTCATCTG | 42 | 44 | 3331 |
| 502234 | 37869 | 37888 | TTCTGAGCCTCAGTTTCCTC | 34 | 54 | 3332 |
| 502235 | 37874 | 37893 | CATTTTTCTGAGCCTCAGTT | 46 | 45 | 3333 |
| 502236 | 37879 | 37898 | CTATTCATTTTTCTGAGCCT | 56 | 65 | 3334 |
| 502237 | 37884 | 37903 | GTAAGCTATTCATTTTTCTG | 50 | 53 | 3335 |
| 502238 | 37889 | 37908 | TCTGTGTAAGCTATTCATTT | 44 | 55 | 3336 |
| 502239 | 37894 | 37913 | CTGGTTCTGTGTAAGCTATT | 55 | 55 | 3337 |
| 502240 | 37899 | 37918 | GTTGTCTGGTTCTGTGTAAG | 31 | 38 | 3338 |
| 502241 | 37904 | 37923 | TTGGAGTTGTCTGGTTCTGT | 52 | 52 | 3339 |
| 502242 | 37989 | 38008 | TGGATCCACTCCCCATCCCC | 0 | 30 | 3340 |
| 502243 | 37994 | 38013 | GCCCATGGATCCACTCCCCA | 0 | 0 | 3341 |
| 502244 | 37999 | 38018 | GGGTTGCCCATGGATCCACT | 0 | 10 | 3342 |
| 502245 | 38004 | 38023 | AGTCAGGGTTGCCCATGGAT | 9 | 13 | 3343 |
| 502246 | 38270 | 38289 | CCAAGGAGTCTGCTGCCCTG | 15 | 16 | 3344 |
| 502247 | 38292 | 38311 | GTCTGGGTCCTGTCTTCAGG | 17 | 15 | 3345 |
| 502248 | 38326 | 38345 | CAGAATGACTGACTCCCTTC | 10 | 19 | 3346 |
| 502249 | 38356 | 38375 | GCAGTCTGGGCTCCAACATC | 0 | 5 | 3347 |
| 502250 | 38361 | 38380 | ACTGTGCAGTCTGGGCTCCA | 0 | 7 | 3348 |
| 502251 | 38366 | 38385 | CCCACACTGTGCAGTCTGGG | 5 | 10 | 3349 |

TABLE 48-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 502252 | 38371 | 38390 | CTTGGCCCACACTGTGCAGT | 4 | 8 | 3350 |
| 502253 | 38376 | 38395 | GCAAACTTGGCCCACACTGT | 2 | 0 | 3351 |
| 502254 | 38381 | 38400 | CATGGGCAAACTTGGCCCAC | 21 | 22 | 3352 |
| 502255 | 38386 | 38405 | ACACACATGGGCAAACTTGG | 0 | 0 | 3353 |
| 502256 | 38391 | 38410 | CCCAGACACACATGGGCAAA | 0 | 0 | 3354 |
| 502257 | 38396 | 38415 | GCCCACCCAGACACACATGG | 0 | 5 | 3355 |
| 502258 | 38401 | 38420 | TCTGTGCCCACCCAGACACA | 0 | 13 | 3356 |
| 502259 | 38406 | 38425 | TTGCATCTGTGCCCACCCAG | 5 | 22 | 3357 |
| 502260 | 38411 | 38430 | ACAGGTTGCATCTGTGCCCA | 33 | 45 | 3358 |
| 502261 | 38478 | 38497 | GGCCCCAGGTGGTCCAGTCC | 0 | 4 | 3359 |
| 502262 | 38483 | 38502 | ATTCTGGCCCCAGGTGGTCC | 0 | 10 | 3360 |
| 502263 | 38505 | 38524 | TGGTCTCCCAGCAAAATGAT | 0 | 0 | 3361 |
| 502264 | 38510 | 38529 | CCTCCTGGTCTCCCAGCAAA | 0 | 0 | 3362 |
| 502265 | 38515 | 38534 | CCTGACCTCCTGGTCTCCCA | 0 | 7 | 3363 |
| 502266 | 38520 | 38539 | TCCTTCCTGACCTCCTGGTC | 3 | 16 | 3364 |
| 502267 | 38525 | 38544 | CACCCTCCTTCCTGACCTCC | 0 | 3 | 3365 |
| 502268 | 38595 | 38614 | TTCCAAAGCCTGAGGTAAGG | 18 | 36 | 3366 |
| 502269 | 38600 | 38619 | TCTTCTTCCAAAGCCTGAGG | 14 | 40 | 3367 |
| 502270 | 38605 | 38624 | CAGCCTCTTCTTCCAAAGCC | 10 | 9 | 3368 |
| 502271 | 38630 | 38649 | CTGGCCCAGGGCTGAGCCTG | 0 | 0 | 3369 |
| 502272 | 38676 | 38695 | TCCCTGAAGGCAGGGACTGG | 0 | 10 | 3370 |
| 502273 | 38681 | 38700 | GGTGCTCCCTGAAGGCAGGG | 24 | 28 | 3371 |
| 502274 | 38686 | 38705 | CCCTTGGTGCTCCCTGAAGG | 0 | 15 | 3372 |
| 502275 | 38726 | 38745 | CACACTGTGTTGTCACTGTC | 41 | 44 | 3373 |
| 502276 | 38731 | 38750 | CTCAGCACACTGTGTTGTCA | 38 | 48 | 3374 |
| 502277 | 38736 | 38755 | ACAGTCTCAGCACACTGTGT | 6 | 21 | 3375 |
| 502278 | 38759 | 38778 | AGCCCTGGACTCACCATTGT | 0 | 4 | 3376 |
| 502279 | 38764 | 38783 | CTCTCAGCCCTGGACTCACC | 6 | 8 | 3377 |
| 502280 | 38809 | 38828 | GCCTCTGCCAGGAAGTTCTC | 8 | 6 | 3378 |
| 502281 | 38814 | 38833 | GGCCTGCCTCTGCCAGGAAG | 0 | 51 | 3379 |
| 502282 | 38819 | 38838 | TGCAGGGCCTGCCTCTGCCA | 9 | 2 | 3380 |
| 502283 | 38843 | 38862 | GAATGCCTGTTTTCCACCTC | 34 | 53 | 3381 |
| 502284 | 38848 | 38867 | CTCTGGAATGCCTGTTTTCC | 19 | 27 | 3382 |
| 502285 | 38874 | 38893 | AGGCAAAGGGAAGGCTGAGC | 4 | 23 | 3383 |

TABLE 49

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 413433 | 32431 | 32450 | GCCTGGACAAGTCCTGCCCA | 74 | 73 | 425 |
| 502286 | 38879 | 38898 | CCCCCAGGCAAAGGGAAGGC | 0 | 16 | 3384 |
| 502287 | 38928 | 38947 | GCCTTCTGCCCCACTGCTAG | 0 | 6 | 3385 |
| 502288 | 38933 | 38952 | GATGGGCCTTCTGCCCCACT | 0 | 0 | 3386 |
| 502289 | 38938 | 38957 | GTTCTGATGGGCCTTCTGCC | 0 | 15 | 3387 |
| 502290 | 38943 | 38962 | ACCAGGTTCTGATGGGCCTT | 0 | 42 | 3388 |
| 502291 | 38948 | 38967 | TCTCTACCAGGTTCTGATGG | 0 | 2 | 3389 |
| 502292 | 39030 | 39049 | GGCCCTGGACACTGGCCAAG | 0 | 12 | 3390 |
| 502293 | 39035 | 39054 | CTAGAGGCCCTGGACACTGG | 0 | 16 | 3391 |
| 502294 | 39041 | 39060 | GTCAGCCTAGAGGCCCTGGA | 18 | 40 | 3392 |
| 502295 | 39082 | 39101 | CCAGGGTCTGTCATACCCTA | 0 | 0 | 3393 |
| 502296 | 39087 | 39106 | AGAGGCCAGGGTCTGTCATA | 0 | 0 | 3394 |
| 502297 | 39097 | 39116 | TCTGGAAGGGAGAGGCCAGG | 0 | 0 | 3395 |
| 502298 | 39301 | 39320 | ACCAACAGTGGTGATGGGCT | 7 | 24 | 3396 |
| 502299 | 39306 | 39325 | GGCTTACCAACAGTGGTGAT | 0 | 0 | 3397 |
| 502300 | 39337 | 39356 | GTTCAGGACAGCCCTTGGTC | 25 | 35 | 3398 |
| 502301 | 39342 | 39361 | CCTGTGTTCAGGACAGCCCT | 26 | 31 | 3399 |
| 502302 | 39347 | 39366 | GGCACCCTGTGTTCAGGACA | 41 | 52 | 3400 |
| 502303 | 39377 | 39396 | AATCCCGTCTCTACTGCTGA | 18 | 39 | 3401 |
| 502304 | 39401 | 39420 | TCAGAGCCAGGTGGCCTGCA | 30 | 27 | 3402 |
| 502305 | 39406 | 39425 | GGCCATCAGAGCCAGGTGGC | 0 | 33 | 3403 |
| 502306 | 39411 | 39430 | GGCATGGCCATCAGAGCCAG | 0 | 12 | 3404 |
| 502307 | 39416 | 39435 | CTAAGGGCATGGCCATCAGA | 0 | 23 | 3405 |
| 502308 | 39421 | 39440 | CATGGCTAAGGGCATGGCCA | 0 | 10 | 3406 |
| 502309 | 39426 | 39445 | GTCCTCATGGCTAAGGGCAT | 26 | 29 | 3407 |
| 502310 | 39431 | 39450 | TCAAAGTCCTCATGGCTAAG | 0 | 37 | 3408 |
| 502311 | 39436 | 39455 | ACACTTCAAAGTCCTCATGG | 33 | 52 | 3409 |
| 502312 | 39441 | 39460 | ACCCAACACTTCAAAGTCCT | 44 | 57 | 3410 |
| 502313 | 39446 | 39465 | TCAGCACCCAACACTTCAAA | 35 | 47 | 3411 |
| 502314 | 39514 | 39533 | ATCACAGAGCTTGGTTCATC | 61 | 62 | 3412 |
| 502315 | 39539 | 39558 | GACTGCAGATTTTCTTTCCT | 18 | 40 | 3413 |
| 502316 | 39577 | 39596 | GTCTTCCCTGATAGACTAGT | 43 | 46 | 3414 |
| 502317 | 39614 | 39633 | TCCTCATCACATTCCCCCAC | 37 | 59 | 3415 |
| 502318 | 39665 | 39684 | AGAGTTACCTCCTCCCTGGG | 14 | 25 | 3416 |
| 502319 | 39670 | 39689 | GTGCAAGAGTTACCTCCTCC | 71 | 81 | 3417 |
| 502320 | 39675 | 39694 | TAGCAGTGCAAGAGTTACCT | 61 | 67 | 3418 |

TABLE 49-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 502321 | 39680 | 39699 | TCAGTTAGCAGTGCAAGAGT | 38 | 53 | 3419 |
| 502322 | 39685 | 39704 | TCCTATCAGTTAGCAGTGCA | 73 | 75 | 3420 |
| 502323 | 39690 | 39709 | ATAATTCCTATCAGTTAGCA | 32 | 35 | 3421 |
| 502324 | 39695 | 39714 | GCTAGATAATTCCTATCAGT | 25 | 17 | 3422 |
| 502325 | 39700 | 39719 | ATTTTGCTAGATAATTCCTA | 0 | 0 | 3423 |
| 502326 | 39705 | 39724 | CCTCTATTTTGCTAGATAAT | 1 | 26 | 3424 |
| 502327 | 39727 | 39746 | TTCTGATAAAAATTCTCTTC | 10 | 13 | 3425 |
| 502328 | 39732 | 39751 | ATTGTTTCTGATAAAAATTC | 0 | 0 | 3426 |
| 502329 | 39737 | 39756 | AGGCTATTGTTTCTGATAAA | 34 | 31 | 3427 |
| 502330 | 39813 | 39832 | CTATGCTGCAGTCATATTAA | 35 | 26 | 3428 |
| 502331 | 39818 | 39837 | CAGGTCTATGCTGCAGTCAT | 58 | 45 | 3429 |
| 502332 | 39823 | 39842 | TCTGACAGGTCTATGCTGCA | 46 | 50 | 3430 |
| 502333 | 39828 | 39847 | ACTCTTCTGACAGGTCTATG | 47 | 50 | 3431 |
| 502334 | 39833 | 39852 | TTTCCACTCTTCTGACAGGT | 54 | 72 | 3432 |
| 502335 | 39906 | 39925 | ATTCTTTAGAATCCTCTAAA | 0 | 10 | 3433 |
| 502336 | 39911 | 39930 | AGGTAATTCTTTAGAATCCT | 41 | 62 | 3434 |
| 502337 | 39965 | 39984 | AAGGGCCCATGTGCTCCTGG | 14 | 33 | 3435 |
| 502338 | 39970 | 39989 | CTGCCAAGGGCCCATGTGCT | 10 | 30 | 3436 |
| 502339 | 39975 | 39994 | GTCCACTGCCAAGGGCCCAT | 37 | 51 | 3437 |
| 502340 | 39980 | 39999 | CTCAAGTCCACTGCCAAGGG | 0 | 9 | 3438 |
| 502341 | 39985 | 40004 | GGCCCCTCAAGTCCACTGCC | 0 | 14 | 3439 |
| 502342 | 39990 | 40009 | GCTTTGGCCCCTCAAGTCCA | 13 | 27 | 3440 |
| 502343 | 40041 | 40060 | TAAAAGTACAAGGCAGGACA | 26 | 25 | 3441 |
| 502344 | 40063 | 40082 | TCCCTGTTGCTTTGTCTCTA | 20 | 26 | 3442 |
| 502345 | 40068 | 40087 | CTGCCTCCCTGTTGCTTTGT | 24 | 31 | 3443 |
| 502346 | 40073 | 40092 | TCCTGCTGCCTCCCTGTTGC | 0 | 21 | 3444 |
| 502347 | 40078 | 40097 | AATGTTCCTGCTGCCTCCCT | 0 | 0 | 3445 |
| 502348 | 40083 | 40102 | ATGGAAATGTTCCTGCTGCC | 33 | 33 | 3446 |
| 502349 | 40088 | 40107 | TGTGCATGGAAATGTTCCTG | 39 | 38 | 3447 |
| 502350 | 40093 | 40112 | ACACCTGTGCATGGAAATGT | 7 | 24 | 3448 |
| 502351 | 40098 | 40117 | CAGCCACACCTGTGCATGGA | 56 | 54 | 3449 |
| 502352 | 40103 | 40122 | CTCCCCAGCCACACCTGTGC | 10 | 21 | 3450 |
| 502353 | 40108 | 40127 | AGCCCCTCCCCAGCCACACC | 2 | 0 | 3451 |
| 502354 | 40130 | 40149 | CTTCACATTGCCCACAGGAC | 39 | 41 | 3452 |
| 502355 | 40135 | 40154 | AATTCCTTCACATTGCCCAC | 14 | 19 | 3453 |
| 502356 | 40140 | 40159 | GAGCAAATTCCTTCACATTG | 0 | 0 | 3454 |

TABLE 49-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition (RTS2988_MGB) | % inhibition (RTS2367) | SEQ ID NO |
|---|---|---|---|---|---|---|
| 502357 | 40145 | 40164 | GTGAAGAGCAAATTCCTTCA | 0 | 13 | 3455 |
| 502358 | 40150 | 40169 | TCAAGGTGAAGAGCAAATTC | 0 | 7 | 3456 |
| 502359 | 40155 | 40174 | CATTCTCAAGGTGAAGAGCA | 32 | 20 | 3457 |
| 502360 | 40160 | 40179 | CTCTCCATTCTCAAGGTGAA | 0 | 0 | 3458 |
| 502361 | 40182 | 40201 | CCTCCCAAACACTCTCTGGT | 11 | 11 | 3459 |
| 502362 | 40187 | 40206 | CTTCCCCTCCCAAACACTCT | 2 | 15 | 3460 |

TABLE 50

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 507659 | 26616 | 26635 | AGTCCTGATGATCCCCTACC | 44 | 3384 |
| 507660 | 26617 | 26636 | AAGTCCTGATGATCCCCTAC | 54 | 3385 |
| 507661 | 26618 | 26637 | TAAGTCCTGATGATCCCCTA | 53 | 3386 |
| 507662 | 26619 | 26638 | GTAAGTCCTGATGATCCCCT | 59 | 3387 |
| 507663 | 26621 | 26640 | TGGTAAGTCCTGATGATCCC | 73 | 3388 |
| 507664 | 26622 | 26641 | ATGGTAAGTCCTGATGATCC | 49 | 3389 |
| 507665 | 26623 | 26642 | CATGGTAAGTCCTGATGATC | 68 | 3390 |
| 507666 | 26624 | 26643 | ACATGGTAAGTCCTGATGAT | 35 | 3391 |
| 495752 | 26631 | 26650 | AGCACTGACATGGTAAGTCC | 67 | 3392 |
| 495753 | 26632 | 26651 | CAGCACTGACATGGTAAGTC | 75 | 3393 |
| 495754 | 26633 | 26652 | TCAGCACTGACATGGTAAGT | 50 | 3394 |
| 495755 | 26634 | 26653 | CTCAGCACTGACATGGTAAG | 35 | 3395 |
| 507667 | 26636 | 26655 | TGCTCAGCACTGACATGGTA | 60 | 3396 |
| 507668 | 26637 | 26656 | CTGCTCAGCACTGACATGGT | 56 | 3397 |
| 507669 | 26638 | 26657 | GCTGCTCAGCACTGACATGG | 69 | 3398 |
| 507670 | 26639 | 26658 | AGCTGCTCAGCACTGACATG | 54 | 3399 |
| 507671 | 26712 | 26731 | TGTGAAGTTCTATCCCTTGG | 52 | 3400 |
| 507672 | 26713 | 26732 | CTGTGAAGTTCTATCCCTTG | 40 | 3401 |
| 507673 | 26714 | 26733 | CCTGTGAAGTTCTATCCCTT | 28 | 3402 |
| 507674 | 26715 | 26734 | ACCTGTGAAGTTCTATCCCT | 27 | 3403 |
| 495756 | 26779 | 26798 | CTGCCATTTAATGAGCTTCA | 80 | 3404 |
| 495757 | 26780 | 26799 | TCTGCCATTTAATGAGCTTC | 56 | 3405 |
| 495758 | 26781 | 26800 | CTCTGCCATTTAATGAGCTT | 22 | 3406 |

TABLE 50-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 495759 | 26782 | 26801 | ACTCTGCCATTTAATGAGCT | 13 | 3407 |
| 507675 | 26812 | 26831 | GGAATGCACTGAGTTTCTGC | 64 | 3408 |
| 507676 | 26813 | 26832 | GGGAATGCACTGAGTTTCTG | 39 | 3409 |
| 507677 | 26850 | 26869 | TCACTAATTCTGGGCTTCCA | 66 | 3410 |
| 507678 | 26851 | 26870 | TTCACTAATTCTGGGCTTCC | 51 | 3411 |
| 507679 | 26852 | 26871 | GTTCACTAATTCTGGGCTTC | 70 | 3412 |
| 507680 | 26853 | 26872 | AGTTCACTAATTCTGGGCTT | 37 | 3413 |
| 507681 | 26880 | 26899 | AAGGTGAAGACTGGCTGTTT | 4 | 3414 |
| 507682 | 26881 | 26900 | AAAGGTGAAGACTGGCTGTT | 43 | 3415 |
| 507683 | 26882 | 26901 | TAAAGGTGAAGACTGGCTGT | 46 | 3416 |
| 507684 | 26883 | 26902 | CTAAAGGTGAAGACTGGCTG | 70 | 3417 |
| 507685 | 26885 | 26904 | GCCTAAAGGTGAAGACTGGC | 42 | 3418 |
| 507686 | 26886 | 26905 | GGCCTAAAGGTGAAGACTGG | 18 | 3419 |
| 507687 | 26887 | 26906 | GGGCCTAAAGGTGAAGACTG | 31 | 3420 |
| 507688 | 26888 | 26907 | TGGGCCTAAAGGTGAAGACT | 37 | 3421 |
| 507689 | 27047 | 27066 | AGTTCTTCCAACCAGTGTTT | 66 | 3422 |
| 507690 | 27048 | 27067 | CAGTTCTTCCAACCAGTGTT | 69 | 3423 |
| 507691 | 27049 | 27068 | TCAGTTCTTCCAACCAGTGT | 63 | 3424 |
| 507692 | 27050 | 27069 | CTCAGTTCTTCCAACCAGTG | 83 | 3425 |
| 507693 | 27052 | 27071 | TGCTCAGTTCTTCCAACCAG | 79 | 3426 |
| 507694 | 27053 | 27072 | TTGCTCAGTTCTTCCAACCA | 80 | 3427 |
| 507695 | 27054 | 27073 | TTTGCTCAGTTCTTCCAACC | 78 | 3428 |
| 507696 | 27055 | 27074 | GTTTGCTCAGTTCTTCCAAC | 85 | 3429 |
| 507697 | 27057 | 27076 | TAGTTTGCTCAGTTCTTCCA | 30 | 3430 |
| 507698 | 27058 | 27077 | TTAGTTTGCTCAGTTCTTCC | 55 | 3431 |
| 507699 | 27059 | 27078 | TTTAGTTTGCTCAGTTCTTC | 27 | 3432 |
| 507700 | 27060 | 27079 | GTTTAGTTTGCTCAGTTCTT | 48 | 3433 |
| 507701 | 27217 | 27236 | GTACTTTCTTCTCATGTGAC | 9 | 3434 |
| 507702 | 27218 | 27237 | AGTACTTTCTTCTCATGTGA | 0 | 3435 |
| 507703 | 27219 | 27238 | CAGTACTTTCTTCTCATGTG | 0 | 3436 |
| 507704 | 27220 | 27239 | CCAGTACTTTCTTCTCATGT | 53 | 3437 |
| 507705 | 27222 | 27241 | TCCCAGTACTTTCTTCTCAT | 67 | 3438 |
| 507706 | 27223 | 27242 | GTCCCAGTACTTTCTTCTCA | 57 | 3439 |
| 507707 | 27224 | 27243 | GGTCCCAGTACTTTCTTCTC | 58 | 3440 |
| 507708 | 27225 | 27244 | TGGTCCCAGTACTTTCTTCT | 49 | 3441 |
| 507709 | 27227 | 27246 | CCTGGTCCCAGTACTTTCTT | 65 | 3442 |

TABLE 50-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 507710 | 27228 | 27247 | TCCTGGTCCCAGTACTTTCT | 77 | 3443 |
| 507711 | 27229 | 27248 | GTCCTGGTCCCAGTACTTTC | 69 | 3444 |
| 507712 | 27230 | 27249 | TGTCCTGGTCCCAGTACTTT | 64 | 3445 |
| 507713 | 27232 | 27251 | CTTGTCCTGGTCCCAGTACT | 61 | 3446 |
| 507714 | 27233 | 27252 | TCTTGTCCTGGTCCCAGTAC | 61 | 3447 |
| 507715 | 27234 | 27253 | TTCTTGTCCTGGTCCCAGTA | 67 | 3448 |
| 507716 | 27235 | 27254 | GTTCTTGTCCTGGTCCCAGT | 76 | 3449 |
| 507717 | 27237 | 27256 | GGGTTCTTGTCCTGGTCCCA | 80 | 3450 |
| 507718 | 27238 | 27257 | TGGGTTCTTGTCCTGGTCCC | 71 | 3451 |
| 507719 | 27239 | 27258 | CTGGGTTCTTGTCCTGGTCC | 62 | 3452 |
| 507720 | 27240 | 27259 | CCTGGGTTCTTGTCCTGGTC | 55 | 3453 |
| 413433 | 32431 | 32450 | GCCTGGACAAGTCCTGCCCA | 69 | 425 |
| 507721 | 35662 | 35681 | AAAAATATACATGCTCTTTT | 0 | 3461 |
| 507722 | 35663 | 35682 | CAAAAATATACATGCTCTTT | 29 | 3462 |
| 507723 | 35664 | 35683 | TCAAAAATATACATGCTCTT | 45 | 3463 |
| 507724 | 35665 | 35684 | CTCAAAAATATACATGCTCT | 74 | 3464 |
| 507725 | 35667 | 35686 | TACTCAAAAATATACATGCT | 51 | 3465 |
| 507726 | 35668 | 35687 | CTACTCAAAAATATACATGC | 63 | 3466 |
| 507727 | 35669 | 35688 | TCTACTCAAAAATATACATG | 0 | 3467 |

TABLE 51

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522363 | 12807 | 12826 | CCAGCACTAATTTTTACAAC | 72 | 3468 |
| 522364 | 12808 | 12827 | TCCAGCACTAATTTTTACAA | 49 | 3469 |
| 522365 | 12809 | 12828 | ATCCAGCACTAATTTTTACA | 65 | 3470 |
| 522366 | 13442 | 13461 | GTGGCTCTCTAGATAGGGTG | 80 | 3471 |
| 522367 | 14193 | 14212 | CTCAGCCTTGGAGCCAGCTC | 59 | 3472 |
| 522368 | 14194 | 14213 | ACTCAGCCTTGGAGCCAGCT | 72 | 3473 |
| 522369 | 14195 | 14214 | CACTCAGCCTTGGAGCCAGC | 63 | 3474 |
| 522370 | 14196 | 14215 | CCACTCAGCCTTGGAGCCAG | 71 | 3475 |
| 522371 | 14198 | 14217 | TGCCACTCAGCCTTGGAGCC | 67 | 3476 |

TABLE 51-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522372 | 14199 | 14218 | TTGCCACTCAGCCTTGGAGC | 62 | 3477 |
| 522373 | 15319 | 15338 | GGAGTTTGTGTTTCCCATTT | 83 | 3478 |
| 522374 | 15321 | 15340 | AAGGAGTTTGTGTTTCCCAT | 83 | 3479 |
| 522375 | 15322 | 15341 | AAAGGAGTTTGTGTTTCCCA | 83 | 3480 |
| 522376 | 15324 | 15343 | GAAAAGGAGTTTGTGTTTCC | 50 | 3481 |
| 522377 | 15325 | 15344 | AGAAAAGGAGTTTGTGTTTC | 17 | 3482 |
| 522378 | 15326 | 15345 | AAGAAAAGGAGTTTGTGTTT | 30 | 3483 |
| 522379 | 15327 | 15346 | TAAGAAAAGGAGTTTGTGTT | 21 | 3484 |
| 522380 | 15569 | 15588 | ATTTTCACAAGGAGAAGCTG | 40 | 3485 |
| 522381 | 15570 | 15589 | CATTTTCACAAGGAGAAGCT | 44 | 3486 |
| 522382 | 15571 | 15590 | CCATTTTCACAAGGAGAAGC | 32 | 3487 |
| 522383 | 15574 | 15593 | GCACCATTTTCACAAGGAGA | 84 | 3488 |
| 522384 | 15575 | 15594 | TGCACCATTTTCACAAGGAG | 77 | 3489 |
| 522385 | 15576 | 15595 | GTGCACCATTTTCACAAGGA | 72 | 3490 |
| 522386 | 15577 | 15596 | AGTGCACCATTTTCACAAGG | 65 | 3491 |
| 522387 | 15647 | 15666 | CATCACAATATATGGGCAAG | 44 | 3492 |
| 522388 | 15648 | 15667 | CCATCACAATATATGGGCAA | 51 | 3493 |
| 522389 | 15649 | 15668 | CCCATCACAATATATGGGCA | 60 | 3494 |
| 522390 | 15650 | 15669 | CCCCATCACAATATATGGGC | 55 | 3495 |
| 522391 | 15877 | 15896 | AGGTAAGGCCAAGGAAGTGA | 69 | 3496 |
| 522392 | 15878 | 15897 | GAGGTAAGGCCAAGGAAGTG | 50 | 3497 |
| 522393 | 15879 | 15898 | AGAGGTAAGGCCAAGGAAGT | 43 | 3498 |
| 522394 | 15880 | 15899 | AAGAGGTAAGGCCAAGGAAG | 57 | 3499 |
| 522395 | 15934 | 15953 | CACCTGGGTTTTTGTGTATT | 66 | 3500 |
| 522396 | 15935 | 15954 | ACACCTGGGTTTTTGTGTAT | 61 | 3501 |
| 522397 | 15936 | 15955 | TACACCTGGGTTTTTGTGTA | 37 | 3502 |
| 522398 | 15937 | 15956 | ATACACCTGGGTTTTTGTGT | 69 | 3503 |
| 522399 | 16047 | 16066 | TCTGAGTGCTGCTAACTTGG | 77 | 3504 |
| 522400 | 16048 | 16067 | ATCTGAGTGCTGCTAACTTG | 65 | 3505 |
| 522401 | 16049 | 16068 | AATCTGAGTGCTGCTAACTT | 62 | 3506 |
| 522402 | 16050 | 16069 | AAATCTGAGTGCTGCTAACT | 60 | 3507 |
| 522403 | 16052 | 16071 | TGAAATCTGAGTGCTGCTAA | 68 | 3508 |
| 522404 | 16053 | 16072 | TTGAAATCTGAGTGCTGCTA | 74 | 3509 |
| 522405 | 16054 | 16073 | GTTGAAATCTGAGTGCTGCT | 78 | 3510 |
| 522406 | 16083 | 16102 | GCACTAAATTAGGAAGCTGG | 77 | 3511 |
| 522407 | 16084 | 16103 | AGCACTAAATTAGGAAGCTG | 65 | 3512 |

TABLE 51-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522408 | 16289 | 16308 | CTGGGACATCTGGCCCAAAG | 72 | 3513 |
| 522409 | 16290 | 16309 | ACTGGGACATCTGGCCCAAA | 71 | 3514 |
| 522410 | 16291 | 16310 | CACTGGGACATCTGGCCCAA | 66 | 3515 |
| 522411 | 16292 | 16311 | CCACTGGGACATCTGGCCCA | 71 | 3516 |
| 522412 | 16294 | 16313 | GCCCACTGGGACATCTGGCC | 61 | 3517 |
| 522413 | 16295 | 16314 | GGCCCACTGGGACATCTGGC | 68 | 3518 |
| 522414 | 16306 | 16325 | CCTTAAAGCAGGGCCCACTG | 50 | 3519 |
| 522415 | 16307 | 16326 | TCCTTAAAGCAGGGCCCACT | 58 | 3520 |
| 522416 | 16308 | 16327 | ATCCTTAAAGCAGGGCCCAC | 67 | 3521 |
| 522417 | 16309 | 16328 | TATCCTTAAAGCAGGGCCCA | 63 | 3522 |
| 522418 | 16429 | 16448 | CACTGGTGCCTAAGAGCCCT | 70 | 3523 |
| 522419 | 16430 | 16449 | CCACTGGTGCCTAAGAGCCC | 63 | 3524 |
| 522420 | 16431 | 16450 | TCCACTGGTGCCTAAGAGCC | 61 | 3525 |
| 522421 | 16432 | 16451 | CTCCACTGGTGCCTAAGAGC | 73 | 3526 |
| 522422 | 16809 | 16828 | GAGGCTGAGTTCTGCTCCTG | 77 | 3527 |
| 522423 | 16810 | 16829 | AGAGGCTGAGTTCTGCTCCT | 59 | 3528 |
| 522424 | 16811 | 16830 | TAGAGGCTGAGTTCTGCTCC | 71 | 3529 |
| 522425 | 16812 | 16831 | CTAGAGGCTGAGTTCTGCTC | 60 | 3530 |
| 522426 | 16814 | 16833 | TGCTAGAGGCTGAGTTCTGC | 65 | 3531 |
| 522427 | 16815 | 16834 | CTGCTAGAGGCTGAGTTCTG | 71 | 3532 |
| 522428 | 16816 | 16835 | TCTGCTAGAGGCTGAGTTCT | 74 | 3533 |
| 522429 | 16817 | 16836 | ATCTGCTAGAGGCTGAGTTC | 67 | 3534 |
| 522430 | 16824 | 16843 | CTTGGGCATCTGCTAGAGGC | 69 | 3535 |
| 522431 | 16825 | 16844 | TCTTGGGCATCTGCTAGAGG | 66 | 3536 |
| 522432 | 16826 | 16845 | TTCTTGGGCATCTGCTAGAG | 65 | 3537 |
| 522433 | 16827 | 16846 | CTTCTTGGGCATCTGCTAGA | 62 | 3538 |
| 522434 | 16829 | 16848 | TGCTTCTTGGGCATCTGCTA | 71 | 3539 |
| 522435 | 16830 | 16849 | CTGCTTCTTGGGCATCTGCT | 81 | 3540 |
| 522436 | 16831 | 16850 | TCTGCTTCTTGGGCATCTGC | 80 | 3541 |
| 522437 | 16832 | 16851 | CTCTGCTTCTTGGGCATCTG | 82 | 3542 |
| 522438 | 16834 | 16853 | TCCTCTGCTTCTTGGGCATC | 67 | 3543 |
| 522439 | 16835 | 16854 | CTCCTCTGCTTCTTGGGCAT | 68 | 3544 |
| 413433 | 32431 | 32450 | GCCTGGACAAGTCCTGCCCA | 82 | 425 |

TABLE 52

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522440 | 16836 | 16855 | TCTCCTCTGCTTCTTGGGCA | 78 | 3545 |
| 522441 | 16897 | 16916 | CTTTCTAAGTACCCTTTACA | 37 | 3546 |
| 522442 | 16898 | 16917 | GCTTTCTAAGTACCCTTTAC | 71 | 3547 |
| 522443 | 16899 | 16918 | TGCTTTCTAAGTACCCTTTA | 62 | 3548 |
| 522444 | 16900 | 16919 | GTGCTTTCTAAGTACCCTTT | 85 | 3549 |
| 522445 | 16902 | 16921 | CAGTGCTTTCTAAGTACCCT | 86 | 3550 |
| 522446 | 17008 | 17027 | AGGGAAAGGTCTTCTCCAGC | 74 | 3551 |
| 522447 | 17009 | 17028 | GAGGGAAAGGTCTTCTCCAG | 67 | 3552 |
| 522448 | 17010 | 17029 | GGAGGGAAAGGTCTTCTCCA | 62 | 3553 |
| 522449 | 17011 | 17030 | AGGAGGGAAAGGTCTTCTCC | 60 | 3554 |
| 522450 | 17208 | 17227 | GTCTCATTCATCTGGGCCCT | 80 | 3555 |
| 522451 | 17209 | 17228 | TGTCTCATTCATCTGGGCCC | 65 | 3556 |
| 522452 | 17210 | 17229 | ATGTCTCATTCATCTGGGCC | 72 | 3557 |
| 522453 | 17270 | 17289 | CCCCTGTACTCAGCCCTTTC | 49 | 3558 |
| 522454 | 17271 | 17290 | ACCCCTGTACTCAGCCCTTT | 60 | 3559 |
| 522455 | 17272 | 17291 | CACCCCTGTACTCAGCCCTT | 51 | 3560 |
| 522456 | 17273 | 17292 | TCACCCCTGTACTCAGCCCT | 61 | 3561 |
| 522457 | 17275 | 17294 | TCTCACCCCTGTACTCAGCC | 70 | 3562 |
| 522458 | 17276 | 17295 | ATCTCACCCCTGTACTCAGC | 58 | 3563 |
| 522459 | 17277 | 17296 | CATCTCACCCCTGTACTCAG | 51 | 3564 |
| 522460 | 17278 | 17297 | CCATCTCACCCCTGTACTCA | 54 | 3565 |
| 522461 | 17329 | 17348 | AAGTCTTCCTTCTCCTCCAC | 65 | 3566 |
| 522462 | 17330 | 17349 | AAAGTCTTCCTTCTCCTCCA | 71 | 3567 |
| 522463 | 17331 | 17350 | GAAAGTCTTCCTTCTCCTCC | 75 | 3568 |
| 522464 | 17332 | 17351 | GGAAAGTCTTCCTTCTCCTC | 75 | 3569 |
| 522465 | 17451 | 17470 | CAGGTAGAGTTCTATTGCTT | 80 | 3570 |
| 522466 | 17452 | 17471 | CCAGGTAGAGTTCTATTGCT | 77 | 3571 |
| 522467 | 19361 | 19380 | GGCTACTGGCATTGCTCCTC | 74 | 3572 |
| 522468 | 19362 | 19381 | TGGCTACTGGCATTGCTCCT | 56 | 3573 |
| 522469 | 19363 | 19382 | GTGGCTACTGGCATTGCTCC | 68 | 3574 |
| 522470 | 19364 | 19383 | GGTGGCTACTGGCATTGCTC | 74 | 3575 |
| 522471 | 19909 | 19928 | ACATGCCTGAGGGCAGCAGT | 68 | 3576 |
| 522472 | 19910 | 19929 | CACATGCCTGAGGGCAGCAG | 69 | 3577 |
| 522473 | 19911 | 19930 | TCACATGCCTGAGGGCAGCA | 81 | 3578 |
| 522474 | 19912 | 19931 | CTCACATGCCTGAGGGCAGC | 79 | 3579 |
| 522475 | 19984 | 20003 | AATATCTGATATCAAAGTGA | 14 | 3580 |

TABLE 52-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522476 | 19985 | 20004 | CAATATCTGATATCAAAGTG | 14 | 3581 |
| 522477 | 19986 | 20005 | CCAATATCTGATATCAAAGT | 41 | 3582 |
| 522478 | 19987 | 20006 | CCCAATATCTGATATCAAAG | 74 | 3583 |
| 522479 | 19989 | 20008 | TGCCCAATATCTGATATCAA | 73 | 3584 |
| 522480 | 19990 | 20009 | TTGCCCAATATCTGATATCA | 65 | 3585 |
| 522481 | 20297 | 20316 | TTGCTTGAGGTCAGGGTGTG | 62 | 3586 |
| 522482 | 20298 | 20317 | CTTGCTTGAGGTCAGGGTGT | 72 | 3587 |
| 522483 | 20299 | 20318 | ACTTGCTTGAGGTCAGGGTG | 68 | 3588 |
| 522484 | 20300 | 20319 | CACTTGCTTGAGGTCAGGGT | 84 | 3589 |
| 522485 | 20302 | 20321 | ATCACTTGCTTGAGGTCAGG | 82 | 3590 |
| 522486 | 20303 | 20322 | AATCACTTGCTTGAGGTCAG | 77 | 3591 |
| 522487 | 20304 | 20323 | AAATCACTTGCTTGAGGTCA | 75 | 3592 |
| 522488 | 20305 | 20324 | AAAATCACTTGCTTGAGGTC | 71 | 3593 |
| 522489 | 20669 | 20688 | GGTACAAGTTTCTCCACCTA | 75 | 3594 |
| 522490 | 20670 | 20689 | AGGTACAAGTTTCTCCACCT | 74 | 3595 |
| 522491 | 20671 | 20690 | TAGGTACAAGTTTCTCCACC | 47 | 3596 |
| 522492 | 20672 | 20691 | CTAGGTACAAGTTTCTCCAC | 72 | 3597 |
| 522493 | 20828 | 20847 | ATAGCTGAGCAAATCCATAA | 63 | 3598 |
| 522494 | 20829 | 20848 | CATAGCTGAGCAAATCCATA | 73 | 3599 |
| 522495 | 20830 | 20849 | GCATAGCTGAGCAAATCCAT | 80 | 3600 |
| 522496 | 20831 | 20850 | TGCATAGCTGAGCAAATCCA | 72 | 3601 |
| 522497 | 20833 | 20852 | ACTGCATAGCTGAGCAAATC | 63 | 3602 |
| 522498 | 20834 | 20853 | TACTGCATAGCTGAGCAAAT | 67 | 3603 |
| 522499 | 20835 | 20854 | TTACTGCATAGCTGAGCAAA | 65 | 3604 |
| 522500 | 20836 | 20855 | TTTACTGCATAGCTGAGCAA | 65 | 3605 |
| 522501 | 20838 | 20857 | GGTTTACTGCATAGCTGAGC | 85 | 3606 |
| 522502 | 20839 | 20858 | AGGTTTACTGCATAGCTGAG | 65 | 3607 |
| 522503 | 20840 | 20859 | GAGGTTTACTGCATAGCTGA | 72 | 3608 |
| 522504 | 20841 | 20860 | AGAGGTTTACTGCATAGCTG | 75 | 3609 |
| 522505 | 20843 | 20862 | ATAGAGGTTTACTGCATAGC | 71 | 3610 |
| 522506 | 20844 | 20863 | CATAGAGGTTTACTGCATAG | 65 | 3611 |
| 522507 | 20956 | 20975 | ACTCTCTCTGCACACTCCCA | 62 | 3612 |
| 522508 | 20957 | 20976 | CACTCTCTCTGCACACTCCC | 61 | 3613 |
| 522509 | 20958 | 20977 | GCACTCTCTCTGCACACTCC | 80 | 3614 |
| 522510 | 20959 | 20978 | TGCACTCTCTCTGCACACTC | 76 | 3615 |

TABLE 52-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522511 | 21934 | 21953 | TGCTGATTACAAGCTGATTC | 64 | 3616 |
| 522512 | 21935 | 21954 | CTGCTGATTACAAGCTGATT | 67 | 3617 |
| 522513 | 21936 | 21955 | ACTGCTGATTACAAGCTGAT | 61 | 3618 |
| 522514 | 21937 | 21956 | AACTGCTGATTACAAGCTGA | 55 | 3619 |
| 522515 | 22152 | 22171 | TGGTGATAAGGCAGCAGTCT | 53 | 3620 |
| 522516 | 22153 | 22172 | ATGGTGATAAGGCAGCAGTC | 62 | 3621 |
| 413433 | 32431 | 32450 | GCCTGGACAAGTCCTGCCCA | 81 | 425 |

TABLE 53

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522517 | 22154 | 22173 | GATGGTGATAAGGCAGCAGT | 67 | 3622 |
| 522518 | 22155 | 22174 | AGATGGTGATAAGGCAGCAG | 71 | 3623 |
| 522519 | 22157 | 22176 | AGAGATGGTGATAAGGCAGC | 58 | 3624 |
| 522520 | 22158 | 22177 | CAGAGATGGTGATAAGGCAG | 38 | 3625 |
| 522521 | 22159 | 22178 | CCAGAGATGGTGATAAGGCA | 60 | 3626 |
| 522522 | 22160 | 22179 | CCCAGAGATGGTGATAAGGC | 67 | 3627 |
| 522523 | 23856 | 23875 | AGACTTGCCCAGCAACCCAT | 49 | 3628 |
| 522524 | 23857 | 23876 | CAGACTTGCCCAGCAACCCA | 58 | 3629 |
| 522525 | 23858 | 23877 | CCAGACTTGCCCAGCAACCC | 61 | 3630 |
| 522526 | 23859 | 23878 | TCCAGACTTGCCCAGCAACC | 57 | 3631 |
| 522527 | 24120 | 24139 | AAACCTAGGTTCAGACTTTG | 51 | 3632 |
| 522528 | 24121 | 24140 | CAAACCTAGGTTCAGACTTT | 48 | 3633 |
| 522529 | 24123 | 24142 | GTCAAACCTAGGTTCAGACT | 84 | 3634 |
| 522530 | 24125 | 24144 | GAGTCAAACCTAGGTTCAGA | 66 | 3635 |
| 522531 | 24126 | 24145 | AGAGTCAAACCTAGGTTCAG | 48 | 3636 |
| 522532 | 24127 | 24146 | AAGAGTCAAACCTAGGTTCA | 50 | 3637 |
| 522533 | 24128 | 24147 | GAAGAGTCAAACCTAGGTTC | 61 | 3638 |
| 522534 | 25019 | 25038 | GAGCATCCCCAATCCCTGCT | 72 | 3639 |
| 522535 | 25020 | 25039 | TGAGCATCCCCAATCCCTGC | 63 | 3640 |
| 522536 | 25021 | 25040 | TTGAGCATCCCCAATCCCTG | 56 | 3641 |
| 522537 | 25022 | 25041 | TTTGAGCATCCCCAATCCCT | 48 | 3642 |
| 522538 | 25024 | 25043 | ACTTTGAGCATCCCCAATCC | 42 | 3643 |

TABLE 53-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522539 | 25025 | 25044 | TACTTTGAGCATCCCCAATC | 53 | 3644 |
| 522540 | 25026 | 25045 | GTACTTTGAGCATCCCCAAT | 70 | 3645 |
| 522541 | 25027 | 25046 | TGTACTTTGAGCATCCCCAA | 68 | 3646 |
| 522542 | 25029 | 25048 | AGTGTACTTTGAGCATCCCC | 77 | 3647 |
| 522543 | 25030 | 25049 | AAGTGTACTTTGAGCATCCC | 70 | 3648 |
| 522544 | 25031 | 25050 | CAAGTGTACTTTGAGCATCC | 73 | 3649 |
| 522545 | 25032 | 25051 | CCAAGTGTACTTTGAGCATC | 76 | 3650 |
| 522546 | 25034 | 25053 | CTCCAAGTGTACTTTGAGCA | 82 | 3651 |
| 522547 | 25070 | 25089 | CAGAGGTTCAACATCCAATT | 74 | 3652 |
| 522548 | 25071 | 25090 | ACAGAGGTTCAACATCCAAT | 74 | 3653 |
| 522549 | 25072 | 25091 | GACAGAGGTTCAACATCCAA | 73 | 3654 |
| 522550 | 25073 | 25092 | GGACAGAGGTTCAACATCCA | 82 | 3655 |
| 522551 | 25076 | 25095 | CAAGGACAGAGGTTCAACAT | 53 | 3656 |
| 522552 | 25077 | 25096 | CCAAGGACAGAGGTTCAACA | 72 | 3657 |
| 522553 | 25078 | 25097 | GCCAAGGACAGAGGTTCAAC | 84 | 3658 |
| 522554 | 25079 | 25098 | GGCCAAGGACAGAGGTTCAA | 82 | 3659 |
| 522555 | 25081 | 25100 | GAGGCCAAGGACAGAGGTTC | 80 | 3660 |
| 522556 | 25082 | 25101 | TGAGGCCAAGGACAGAGGTT | 82 | 3661 |
| 522557 | 25083 | 25102 | GTGAGGCCAAGGACAGAGGT | 67 | 3662 |
| 522558 | 25084 | 25103 | TGTGAGGCCAAGGACAGAGG | 63 | 3663 |
| 522559 | 25086 | 25105 | TCTGTGAGGCCAAGGACAGA | 54 | 3664 |
| 522560 | 25087 | 25106 | GTCTGTGAGGCCAAGGACAG | 58 | 3665 |
| 522561 | 25088 | 25107 | TGTCTGTGAGGCCAAGGACA | 71 | 3666 |
| 522562 | 25089 | 25108 | CTGTCTGTGAGGCCAAGGAC | 74 | 3667 |
| 522563 | 25184 | 25203 | AGTCTCTCATAATTGCCAGT | 69 | 3668 |
| 522564 | 25185 | 25204 | AAGTCTCTCATAATTGCCAG | 69 | 3669 |
| 522565 | 25186 | 25205 | GAAGTCTCTCATAATTGCCA | 71 | 3670 |
| 522566 | 25187 | 25206 | GGAAGTCTCTCATAATTGCC | 46 | 3671 |
| 522567 | 25189 | 25208 | TGGGAAGTCTCTCATAATTG | 37 | 3672 |
| 522568 | 25190 | 25209 | TTGGGAAGTCTCTCATAATT | 22 | 3673 |
| 522569 | 25191 | 25210 | CTTGGGAAGTCTCTCATAAT | 23 | 3674 |
| 522570 | 25192 | 25211 | CCTTGGGAAGTCTCTCATAA | 35 | 3675 |
| 522571 | 25194 | 25213 | GGCCTTGGGAAGTCTCTCAT | 51 | 3676 |
| 522572 | 25195 | 25214 | AGGCCTTGGGAAGTCTCTCA | 55 | 3677 |
| 522573 | 25196 | 25215 | TAGGCCTTGGGAAGTCTCTC | 61 | 3678 |

TABLE 53-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522574 | 25197 | 25216 | CTAGGCCTTGGGAAGTCTCT | 43 | 3679 |
| 522575 | 25242 | 25261 | CATTTTGGAGACCACATGAA | 31 | 3680 |
| 522576 | 25243 | 25262 | TCATTTTGGAGACCACATGA | 41 | 3681 |
| 522577 | 25244 | 25263 | GTCATTTTGGAGACCACATG | 60 | 3682 |
| 522578 | 25245 | 25264 | GGTCATTTTGGAGACCACAT | 70 | 3683 |
| 522579 | 25268 | 25287 | AATGGGAATGGTATCGCACT | 84 | 3684 |
| 522580 | 25269 | 25288 | CAATGGGAATGGTATCGCAC | 87 | 3685 |
| 522581 | 25270 | 25289 | ACAATGGGAATGGTATCGCA | 85 | 3686 |
| 522582 | 25271 | 25290 | CACAATGGGAATGGTATCGC | 86 | 3687 |
| 522583 | 25377 | 25396 | AGCTATAGAATCAGACAGAC | 53 | 3688 |
| 522584 | 25378 | 25397 | CAGCTATAGAATCAGACAGA | 56 | 3689 |
| 522585 | 25379 | 25398 | TCAGCTATAGAATCAGACAG | 48 | 3690 |
| 522586 | 25381 | 25400 | CATCAGCTATAGAATCAGAC | 64 | 3691 |
| 522587 | 25783 | 25802 | GCACTTGATCTGGGACCCAA | 87 | 3692 |
| 522588 | 25784 | 25803 | AGCACTTGATCTGGGACCCA | 88 | 3693 |
| 522589 | 25785 | 25804 | GAGCACTTGATCTGGGACCC | 86 | 3694 |
| 522590 | 25786 | 25805 | AGAGCACTTGATCTGGGACC | 76 | 3695 |
| 522591 | 25788 | 25807 | GTAGAGCACTTGATCTGGGA | 74 | 3696 |
| 522592 | 25789 | 25808 | GGTAGAGCACTTGATCTGGG | 79 | 3697 |
| 522593 | 25790 | 25809 | GGGTAGAGCACTTGATCTGG | 61 | 3698 |
| 413433 | 32431 | 32450 | GCCTGGACAAGTCCTGCCCA | 84 | 425 |

TABLE 54

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522594 | 25842 | 25861 | AACTATCACACCACCTCCCA | 44 | 3699 |
| 522595 | 25843 | 25862 | GAACTATCACACCACCTCCC | 42 | 3700 |
| 522596 | 25844 | 25863 | GGAACTATCACACCACCTCC | 47 | 3701 |
| 522597 | 25845 | 25864 | GGGAACTATCACACCACCTC | 61 | 3702 |
| 522598 | 25847 | 25866 | ATGGGAACTATCACACCACC | 64 | 3703 |
| 522599 | 25848 | 25867 | AATGGGAACTATCACACCAC | 33 | 3704 |
| 522600 | 25849 | 25868 | AAATGGGAACTATCACACCA | 37 | 3705 |
| 522601 | 25850 | 25869 | TAAATGGGAACTATCACACC | 16 | 3706 |

TABLE 54-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522602 | 25901 | 25920 | TGACCTTGGGCAAGTTACCT | 74 | 3707 |
| 522603 | 25902 | 25921 | GTGACCTTGGGCAAGTTACC | 76 | 3708 |
| 522604 | 25903 | 25922 | TGTGACCTTGGGCAAGTTAC | 77 | 3709 |
| 522605 | 25904 | 25923 | GTGTGACCTTGGGCAAGTTA | 78 | 3710 |
| 522606 | 25906 | 25925 | CTGTGTGACCTTGGGCAAGT | 80 | 3711 |
| 522607 | 25907 | 25926 | TCTGTGTGACCTTGGGCAAG | 81 | 3712 |
| 522608 | 25908 | 25927 | ATCTGTGTGACCTTGGGCAA | 81 | 3713 |
| 522609 | 25909 | 25928 | AATCTGTGTGACCTTGGGCA | 87 | 3714 |
| 522610 | 25911 | 25930 | CAAATCTGTGTGACCTTGGG | 85 | 3715 |
| 522611 | 25912 | 25931 | TCAAATCTGTGTGACCTTGG | 69 | 3716 |
| 522612 | 25913 | 25932 | TTCAAATCTGTGTGACCTTG | 75 | 3717 |
| 522613 | 25914 | 25933 | ATTCAAATCTGTGTGACCTT | 79 | 3718 |
| 522614 | 25916 | 25935 | GGATTCAAATCTGTGTGACC | 75 | 3719 |
| 522615 | 25917 | 25936 | GGGATTCAAATCTGTGTGAC | 54 | 3720 |
| 522616 | 25918 | 25937 | AGGGATTCAAATCTGTGTGA | 57 | 3721 |
| 522617 | 25919 | 25938 | CAGGGATTCAAATCTGTGTG | 63 | 3722 |
| 522618 | 25951 | 25970 | GGGAAAGGCACAGGCTTTGG | 81 | 3723 |
| 522619 | 25952 | 25971 | TGGGAAAGGCACAGGCTTTG | 70 | 3724 |
| 522620 | 25954 | 25973 | TGTGGGAAAGGCACAGGCTT | 66 | 3725 |
| 522621 | 26006 | 26025 | AGGCAAAGTAACATACCTGC | 87 | 3726 |
| 522622 | 26007 | 26026 | AAGGCAAAGTAACATACCTG | 76 | 3727 |
| 522623 | 26008 | 26027 | TAAGGCAAAGTAACATACCT | 62 | 3728 |
| 522624 | 26009 | 26028 | TTAAGGCAAAGTAACATACC | 69 | 3729 |
| 522625 | 26011 | 26030 | CCTTAAGGCAAAGTAACATA | 73 | 3730 |
| 522626 | 26012 | 26031 | ACCTTAAGGCAAAGTAACAT | 45 | 3731 |
| 522627 | 26166 | 26185 | ATTTCTTATCTTCAATCCTC | 84 | 3732 |
| 522628 | 26167 | 26186 | CATTTCTTATCTTCAATCCT | 64 | 3733 |
| 522629 | 26168 | 26187 | TCATTTCTTATCTTCAATCC | 62 | 3734 |
| 522630 | 26169 | 26188 | CTCATTTCTTATCTTCAATC | 81 | 3735 |
| 522631 | 26171 | 26190 | CTCTCATTTCTTATCTTCAA | 86 | 3736 |
| 522632 | 26172 | 26191 | GCTCTCATTTCTTATCTTCA | 90 | 3737 |
| 522633 | 26173 | 26192 | TGCTCTCATTTCTTATCTTC | 78 | 3738 |
| 522634 | 26174 | 26193 | GTGCTCTCATTTCTTATCTT | 80 | 3739 |
| 522635 | 26176 | 26195 | AGGTGCTCTCATTTCTTATC | 78 | 3740 |
| 522636 | 26177 | 26196 | CAGGTGCTCTCATTTCTTAT | 73 | 3741 |

TABLE 54-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522637 | 26178 | 26197 | CCAGGTGCTCTCATTTCTTA | 74 | 3742 |
| 522638 | 26179 | 26198 | GCCAGGTGCTCTCATTTCTT | 84 | 3743 |
| 522639 | 26201 | 26220 | GCCCATCATGACCAGGCCCT | 60 | 3744 |
| 522640 | 26202 | 26221 | GGCCCATCATGACCAGGCCC | 21 | 3745 |
| 522641 | 26203 | 26222 | GGGCCCATCATGACCAGGCC | 41 | 3746 |
| 522642 | 26301 | 26320 | CAGGCCTCGGGAAGCACCTG | 71 | 3747 |
| 522643 | 26302 | 26321 | GCAGGCCTCGGGAAGCACCT | 86 | 3748 |
| 522644 | 26303 | 26322 | AGCAGGCCTCGGGAAGCACC | 77 | 3749 |
| 522645 | 26304 | 26323 | GAGCAGGCCTCGGGAAGCAC | 80 | 3750 |
| 522646 | 26354 | 26373 | CAGAAAAAGCAACCAAAGCA | 31 | 3751 |
| 522647 | 26355 | 26374 | GCAGAAAAAGCAACCAAAGC | 31 | 3752 |
| 522648 | 26356 | 26375 | TGCAGAAAAAGCAACCAAAG | 34 | 3753 |
| 522649 | 26357 | 26376 | CTGCAGAAAAAGCAACCAAA | 52 | 3754 |
| 522650 | 26359 | 26378 | ACCTGCAGAAAAAGCAACCA | 32 | 3755 |
| 522651 | 26360 | 26379 | GACCTGCAGAAAAAGCAACC | 24 | 3756 |
| 522652 | 26361 | 26380 | AGACCTGCAGAAAAAGCAAC | 17 | 3757 |
| 522653 | 26362 | 26381 | CAGACCTGCAGAAAAAGCAA | 23 | 3758 |
| 522654 | 26386 | 26405 | ACCTAAGGAGTGAGGGTATC | 46 | 3759 |
| 522655 | 26387 | 26406 | AACCTAAGGAGTGAGGGTAT | 58 | 3760 |
| 522656 | 26388 | 26407 | CAACCTAAGGAGTGAGGGTA | 59 | 3761 |
| 522657 | 26389 | 26408 | GCAACCTAAGGAGTGAGGGT | 73 | 3762 |
| 522658 | 27639 | 27658 | TGCTTGCCAGGTGAGCTTCT | 76 | 3763 |
| 522659 | 27640 | 27659 | TTGCTTGCCAGGTGAGCTTC | 65 | 3764 |
| 522660 | 27641 | 27660 | TTTGCTTGCCAGGTGAGCTT | 65 | 3765 |
| 522661 | 27642 | 27661 | CTTTGCTTGCCAGGTGAGCT | 77 | 3766 |
| 522662 | 27644 | 27663 | GTCTTTGCTTGCCAGGTGAG | 74 | 3767 |
| 522663 | 27645 | 27664 | GGTCTTTGCTTGCCAGGTGA | 75 | 3768 |
| 522664 | 27767 | 27786 | CCTTGTATTAAATACTCTAA | 59 | 3769 |
| 522665 | 27768 | 27787 | ACCTTGTATTAAATACTCTA | 57 | 3770 |
| 522666 | 27769 | 27788 | CACCTTGTATTAAATACTCT | 78 | 3771 |
| 522667 | 27770 | 27789 | GCACCTTGTATTAAATACTC | 83 | 3772 |
| 522668 | 27772 | 27791 | ATGCACCTTGTATTAAATAC | 69 | 3773 |
| 522669 | 27773 | 27792 | AATGCACCTTGTATTAAATA | 41 | 3774 |
| 522670 | 27774 | 27793 | CAATGCACCTTGTATTAAAT | 59 | 3775 |
| 413433 | 32431 | 32450 | GCCTGGACAAGTCCTGCCCA | 83 | 425 |

TABLE 55

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522671 | 27775 | 27794 | CCAATGCACCTTGTATTAAA | 83 | 3776 |
| 522672 | 27777 | 27796 | ATCCAATGCACCTTGTATTA | 85 | 3777 |
| 522673 | 27778 | 27797 | AATCCAATGCACCTTGTATT | 77 | 3778 |
| 522674 | 27779 | 27798 | AAATCCAATGCACCTTGTAT | 80 | 3779 |
| 522675 | 27780 | 27799 | GAAATCCAATGCACCTTGTA | 85 | 3780 |
| 522676 | 27782 | 27801 | TTGAAATCCAATGCACCTTG | 86 | 3781 |
| 522677 | 27783 | 27802 | TTTGAAATCCAATGCACCTT | 87 | 3782 |
| 522678 | 27784 | 27803 | CTTTGAAATCCAATGCACCT | 82 | 3783 |
| 522679 | 27785 | 27804 | CCTTTGAAATCCAATGCACC | 88 | 3784 |
| 522680 | 27787 | 27806 | TTCCTTTGAAATCCAATGCA | 82 | 3785 |
| 522681 | 27788 | 27807 | TTTCCTTTGAAATCCAATGC | 82 | 3786 |
| 522682 | 27789 | 27808 | GTTTCCTTTGAAATCCAATG | 87 | 3787 |
| 522683 | 27790 | 27809 | AGTTTCCTTTGAAATCCAAT | 82 | 3788 |
| 522684 | 27850 | 27869 | CTGTTACTACATGTCTAATC | 61 | 3789 |
| 522685 | 27851 | 27870 | CCTGTTACTACATGTCTAAT | 51 | 3790 |
| 522686 | 27852 | 27871 | ACCTGTTACTACATGTCTAA | 68 | 3791 |
| 522687 | 27853 | 27872 | CACCTGTTACTACATGTCTA | 82 | 3792 |
| 522688 | 27855 | 27874 | GGCACCTGTTACTACATGTC | 90 | 3793 |
| 522689 | 27856 | 27875 | AGGCACCTGTTACTACATGT | 88 | 3794 |
| 522690 | 27857 | 27876 | AAGGCACCTGTTACTACATG | 82 | 3795 |
| 522691 | 27858 | 27877 | AAAGGCACCTGTTACTACAT | 80 | 3796 |
| 522692 | 28027 | 28046 | ATCACAGAATTATCAGCAGT | 84 | 3797 |
| 522693 | 28028 | 28047 | AATCACAGAATTATCAGCAG | 79 | 3798 |
| 522694 | 28029 | 28048 | AAATCACAGAATTATCAGCA | 86 | 3799 |
| 522695 | 28030 | 28049 | TAAATCACAGAATTATCAGC | 64 | 3800 |
| 522696 | 28128 | 28147 | CACACAATATCCATGGACTT | 80 | 3801 |
| 522697 | 28129 | 28148 | ACACACAATATCCATGGACT | 88 | 3802 |
| 522698 | 28130 | 28149 | GACACACAATATCCATGGAC | 89 | 3803 |
| 522699 | 28131 | 28150 | TGACACACAATATCCATGGA | 75 | 3804 |
| 522700 | 28133 | 28152 | CCTGACACACAATATCCATG | 80 | 3805 |
| 522701 | 28134 | 28153 | GCCTGACACACAATATCCAT | 79 | 3806 |
| 522702 | 28135 | 28154 | AGCCTGACACACAATATCCA | 72 | 3807 |
| 522703 | 28460 | 28479 | CATGAGAAGCTTAGAAGGCC | 59 | 3808 |
| 522704 | 28462 | 28481 | CTCATGAGAAGCTTAGAAGG | 63 | 3809 |
| 522705 | 28463 | 28482 | GCTCATGAGAAGCTTAGAAG | 83 | 3810 |
| 522706 | 28465 | 28484 | GAGCTCATGAGAAGCTTAGA | 70 | 3811 |

TABLE 55-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522707 | 28466 | 28485 | TGAGCTCATGAGAAGCTTAG | 60 | 3812 |
| 522708 | 28467 | 28486 | CTGAGCTCATGAGAAGCTTA | 69 | 3813 |
| 522709 | 28468 | 28487 | GCTGAGCTCATGAGAAGCTT | 80 | 3814 |
| 522710 | 28470 | 28489 | TTGCTGAGCTCATGAGAAGC | 74 | 3815 |
| 522711 | 28471 | 28490 | GTTGCTGAGCTCATGAGAAG | 66 | 3816 |
| 522712 | 28472 | 28491 | TGTTGCTGAGCTCATGAGAA | 60 | 3817 |
| 522713 | 28473 | 28492 | CTGTTGCTGAGCTCATGAGA | 65 | 3818 |
| 522714 | 28475 | 28494 | CACTGTTGCTGAGCTCATGA | 73 | 3819 |
| 522715 | 28476 | 28495 | CCACTGTTGCTGAGCTCATG | 86 | 3820 |
| 522716 | 28477 | 28496 | ACCACTGTTGCTGAGCTCAT | 86 | 3821 |
| 522717 | 28478 | 28497 | AACCACTGTTGCTGAGCTCA | 87 | 3822 |
| 522718 | 28480 | 28499 | AAACCACTGTTGCTGAGCT | 80 | 3823 |
| 522719 | 28481 | 28500 | AAAACCACTGTTGCTGAGC | 83 | 3824 |
| 522720 | 28482 | 28501 | TAAAACCACTGTTGCTGAG | 69 | 3825 |
| 522721 | 28483 | 28502 | GTAAAACCACTGTTGCTGA | 69 | 3826 |
| 522722 | 28516 | 28535 | TCTGGTTCCATGCTCTTAGG | 70 | 3827 |
| 522723 | 28517 | 28536 | CTCTGGTTCCATGCTCTTAG | 74 | 3828 |
| 522724 | 28518 | 28537 | GCTCTGGTTCCATGCTCTTA | 78 | 3829 |
| 522725 | 28519 | 28538 | GGCTCTGGTTCCATGCTCTT | 75 | 3830 |
| 522726 | 28521 | 28540 | CAGGCTCTGGTTCCATGCTC | 73 | 3831 |
| 522727 | 28522 | 28541 | ACAGGCTCTGGTTCCATGCT | 78 | 3832 |
| 522728 | 28523 | 28542 | AACAGGCTCTGGTTCCATGC | 78 | 3833 |
| 522729 | 28581 | 28600 | TGAACTAAATCCACCAAATG | 22 | 3834 |
| 522730 | 28582 | 28601 | ATGAACTAAATCCACCAAAT | 46 | 3835 |
| 522731 | 28583 | 28602 | GATGAACTAAATCCACCAAA | 46 | 3836 |
| 522732 | 28584 | 28603 | GGATGAACTAAATCCACCAA | 67 | 3837 |
| 522733 | 28586 | 28605 | AAGGATGAACTAAATCCACC | 65 | 3838 |
| 522734 | 28587 | 28606 | AAAGGATGAACTAAATCCAC | 43 | 3839 |
| 522735 | 28588 | 28607 | AAAAGGATGAACTAAATCCA | 33 | 3840 |
| 522736 | 28589 | 28608 | CAAAAGGATGAACTAAATCC | 16 | 3841 |
| 522737 | 28803 | 28822 | AGAGACTGAATTCTAGCCTG | 59 | 3842 |
| 522738 | 28804 | 28823 | CAGAGACTGAATTCTAGCCT | 67 | 3843 |
| 522739 | 28805 | 28824 | CCAGAGACTGAATTCTAGCC | 67 | 3844 |
| 522740 | 28806 | 28825 | TCCAGAGACTGAATTCTAGC | 77 | 3845 |
| 522741 | 28808 | 28827 | TATCCAGAGACTGAATTCTA | 52 | 3846 |

TABLE 55-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522742 | 28809 | 28828 | GTATCCAGAGACTGAATTCT | 46 | 3847 |
| 522743 | 28810 | 28829 | GGTATCCAGAGACTGAATTC | 50 | 3848 |
| 522744 | 28811 | 28830 | GGGTATCCAGAGACTGAATT | 65 | 3849 |
| 522745 | 29011 | 29030 | GTTTAGGCTATGGTCTGAGC | 90 | 3850 |
| 522746 | 29012 | 29031 | GGTTTAGGCTATGGTCTGAG | 78 | 3851 |
| 522747 | 29013 | 29032 | AGGTTTAGGCTATGGTCTGA | 71 | 3852 |
| 413433 | 32431 | 32450 | GCCTGGACAAGTCCTGCCCA | 84 | 425 |

TABLE 56

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522748 | 29014 | 29033 | GAGGTTTAGGCTATGGTCTG | 71 | 3853 |
| 522749 | 29016 | 29035 | ATGAGGTTTAGGCTATGGTC | 67 | 3854 |
| 522750 | 29045 | 29064 | GGATGCTCCAGGTGGGCCAG | 59 | 3855 |
| 522751 | 29046 | 29065 | TGGATGCTCCAGGTGGGCCA | 52 | 3856 |
| 522752 | 29047 | 29066 | GTGGATGCTCCAGGTGGGCC | 57 | 3857 |
| 522753 | 29048 | 29067 | GGTGGATGCTCCAGGTGGGC | 52 | 3858 |
| 522754 | 29140 | 29159 | GTCTGCCTGATTCCCTTTCT | 75 | 3859 |
| 522755 | 29141 | 29160 | AGTCTGCCTGATTCCCTTTC | 58 | 3860 |
| 522756 | 29142 | 29161 | CAGTCTGCCTGATTCCCTTT | 59 | 3861 |
| 522757 | 29143 | 29162 | GCAGTCTGCCTGATTCCCTT | 85 | 3862 |
| 522758 | 29145 | 29164 | CAGCAGTCTGCCTGATTCCC | 79 | 3863 |
| 522759 | 29146 | 29165 | TCAGCAGTCTGCCTGATTCC | 72 | 3864 |
| 522760 | 29147 | 29166 | TTCAGCAGTCTGCCTGATTC | 61 | 3865 |
| 522761 | 29148 | 29167 | GTTCAGCAGTCTGCCTGATT | 71 | 3866 |
| 522762 | 29150 | 29169 | CTGTTCAGCAGTCTGCCTGA | 55 | 3867 |
| 522763 | 29151 | 29170 | ACTGTTCAGCAGTCTGCCTG | 62 | 3868 |
| 522764 | 29152 | 29171 | TACTGTTCAGCAGTCTGCCT | 64 | 3869 |
| 522765 | 29153 | 29172 | TTACTGTTCAGCAGTCTGCC | 61 | 3870 |
| 522766 | 29155 | 29174 | ACTTACTGTTCAGCAGTCTG | 73 | 3871 |
| 522767 | 29156 | 29175 | TACTTACTGTTCAGCAGTCT | 75 | 3872 |
| 522768 | 29157 | 29176 | ATACTTACTGTTCAGCAGTC | 74 | 3873 |
| 522769 | 29158 | 29177 | CATACTTACTGTTCAGCAGT | 74 | 3874 |

TABLE 56-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522770 | 29160 | 29179 | GTCATACTTACTGTTCAGCA | 89 | 3875 |
| 522771 | 29161 | 29180 | AGTCATACTTACTGTTCAGC | 74 | 3876 |
| 522772 | 29162 | 29181 | AAGTCATACTTACTGTTCAG | 39 | 3877 |
| 522773 | 29163 | 29182 | AAAGTCATACTTACTGTTCA | 43 | 3878 |
| 522774 | 29194 | 29213 | TGGTGAATAGCTATGTCTAA | 54 | 3879 |
| 522775 | 29195 | 29214 | TTGGTGAATAGCTATGTCTA | 58 | 3880 |
| 522776 | 29196 | 29215 | CTTGGTGAATAGCTATGTCT | 71 | 3881 |
| 522777 | 29197 | 29216 | GCTTGGTGAATAGCTATGTC | 77 | 3882 |
| 522778 | 29199 | 29218 | TAGCTTGGTGAATAGCTATG | 70 | 3883 |
| 522779 | 29200 | 29219 | GTAGCTTGGTGAATAGCTAT | 50 | 3884 |
| 522780 | 29201 | 29220 | GGTAGCTTGGTGAATAGCTA | 71 | 3885 |
| 522781 | 29243 | 29262 | AGCCTACAAGAGCCTGTTAA | 39 | 3886 |
| 522782 | 29244 | 29263 | CAGCCTACAAGAGCCTGTTA | 67 | 3887 |
| 522783 | 29245 | 29264 | GCAGCCTACAAGAGCCTGTT | 82 | 3888 |
| 522784 | 29246 | 29265 | TGCAGCCTACAAGAGCCTGT | 82 | 3889 |
| 522785 | 29248 | 29267 | TGTGCAGCCTACAAGAGCCT | 64 | 3890 |
| 522786 | 29249 | 29268 | ATGTGCAGCCTACAAGAGCC | 59 | 3891 |
| 522787 | 29250 | 29269 | CATGTGCAGCCTACAAGAGC | 39 | 3892 |
| 522788 | 29251 | 29270 | GCATGTGCAGCCTACAAGAG | 64 | 3893 |
| 522789 | 29253 | 29272 | AAGCATGTGCAGCCTACAAG | 70 | 3894 |
| 522790 | 29254 | 29273 | GAAGCATGTGCAGCCTACAA | 66 | 3895 |
| 522791 | 29255 | 29274 | GGAAGCATGTGCAGCCTACA | 78 | 3896 |
| 522792 | 29256 | 29275 | GGGAAGCATGTGCAGCCTAC | 69 | 3897 |
| 522793 | 29258 | 29277 | TAGGGAAGCATGTGCAGCCT | 74 | 3898 |
| 522794 | 29259 | 29278 | CTAGGGAAGCATGTGCAGCC | 72 | 3899 |
| 522795 | 29260 | 29279 | TCTAGGGAAGCATGTGCAGC | 65 | 3900 |
| 522796 | 29261 | 29280 | TTCTAGGGAAGCATGTGCAG | 61 | 3901 |
| 522797 | 29263 | 29282 | GTTTCTAGGGAAGCATGTGC | 72 | 3902 |
| 522798 | 29264 | 29283 | AGTTTCTAGGGAAGCATGTG | 40 | 3903 |
| 522799 | 29265 | 29284 | AAGTTTCTAGGGAAGCATGT | 46 | 3904 |
| 522800 | 29266 | 29285 | CAAGTTTCTAGGGAAGCATG | 42 | 3905 |
| 522801 | 29362 | 29381 | TACAACTCTCTTGTTGGGAG | 70 | 3906 |
| 522802 | 29363 | 29382 | GTACAACTCTCTTGTTGGGA | 73 | 3907 |
| 522803 | 29364 | 29383 | GGTACAACTCTCTTGTTGGG | 63 | 3908 |
| 522804 | 29365 | 29384 | GGGTACAACTCTCTTGTTGG | 57 | 3909 |

TABLE 56-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522805 | 29367 | 29386 | CAGGGTACAACTCTCTTGTT | 64 | 3910 |
| 522806 | 29368 | 29387 | ACAGGGTACAACTCTCTTGT | 57 | 3911 |
| 522807 | 29369 | 29388 | AACAGGGTACAACTCTCTTG | 85 | 3912 |
| 522808 | 29370 | 29389 | AAACAGGGTACAACTCTCTT | 63 | 3913 |
| 522809 | 29372 | 29391 | AAAAACAGGGTACAACTCTC | 62 | 3914 |
| 522810 | 29373 | 29392 | TAAAAACAGGGTACAACTCT | 32 | 3915 |
| 522811 | 29374 | 29393 | CTAAAAACAGGGTACAACTC | 21 | 3916 |
| 522812 | 29375 | 29394 | GCTAAAAACAGGGTACAACT | 31 | 3917 |
| 522813 | 29476 | 29495 | TGTAGACTCTCCATGAGCCT | 65 | 3918 |
| 522814 | 29477 | 29496 | ATGTAGACTCTCCATGAGCC | 45 | 3919 |
| 522815 | 29478 | 29497 | GATGTAGACTCTCCATGAGC | 25 | 3920 |
| 522816 | 29479 | 29498 | GGATGTAGACTCTCCATGAG | 42 | 3921 |
| 522817 | 30968 | 30987 | TAAGCTAGGCACACCCAGGG | 43 | 3922 |
| 522818 | 30969 | 30988 | CTAAGCTAGGCACACCCAGG | 23 | 3923 |
| 522819 | 30970 | 30989 | ACTAAGCTAGGCACACCCAG | 33 | 3924 |
| 522820 | 30971 | 30990 | CACTAAGCTAGGCACACCCA | 48 | 3925 |
| 522821 | 30973 | 30992 | GGCACTAAGCTAGGCACACC | 78 | 3926 |
| 522822 | 30975 | 30994 | GTGGCACTAAGCTAGGCACA | 69 | 3927 |
| 522823 | 30976 | 30995 | TGTGGCACTAAGCTAGGCAC | 66 | 3928 |
| 522824 | 30978 | 30997 | ACTGTGGCACTAAGCTAGGC | 69 | 3929 |
| 413433 | 32431 | 32450 | GCCTGGACAAGTCCTGCCCA | 85 | 425 |

TABLE 57

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522825 | 30979 | 30998 | TACTGTGGCACTAAGCTAGG | 53 | 3930 |
| 522826 | 30980 | 30999 | TTACTGTGGCACTAAGCTAG | 36 | 3931 |
| 522827 | 30981 | 31000 | TTTACTGTGGCACTAAGCTA | 40 | 3932 |
| 522828 | 30983 | 31002 | TGTTTACTGTGGCACTAAGC | 59 | 3933 |
| 522829 | 30984 | 31003 | GTGTTTACTGTGGCACTAAG | 68 | 3934 |
| 522830 | 30985 | 31004 | AGTGTTTACTGTGGCACTAA | 67 | 3935 |
| 522831 | 30986 | 31005 | GAGTGTTTACTGTGGCACTA | 72 | 3936 |
| 522832 | 31770 | 31789 | ATGGATACTCAGAAGAGCAG | 34 | 3937 |

TABLE 57-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522833 | 31771 | 31790 | GATGGATACTCAGAAGAGCA | 46 | 3938 |
| 522834 | 31793 | 31812 | ACCTCAGGGCTGGCCCAAAG | 47 | 3939 |
| 522835 | 31794 | 31813 | GACCTCAGGGCTGGCCCAAA | 67 | 3940 |
| 522836 | 31795 | 31814 | GGACCTCAGGGCTGGCCCAA | 66 | 3941 |
| 522837 | 31796 | 31815 | AGGACCTCAGGGCTGGCCCA | 68 | 3942 |
| 522838 | 31798 | 31817 | TCAGGACCTCAGGGCTGGCC | 78 | 3943 |
| 522839 | 31799 | 31818 | GTCAGGACCTCAGGGCTGGC | 66 | 3944 |
| 522840 | 31800 | 31819 | TGTCAGGACCTCAGGGCTGG | 53 | 3945 |
| 522841 | 31801 | 31820 | CTGTCAGGACCTCAGGGCTG | 49 | 3946 |
| 522842 | 31933 | 31952 | GAGTTATCCTCAATTCACCA | 74 | 3947 |
| 522843 | 31934 | 31953 | AGAGTTATCCTCAATTCACC | 59 | 3948 |
| 522844 | 31936 | 31955 | CCAGAGTTATCCTCAATTCA | 71 | 3949 |
| 522845 | 31938 | 31957 | TGCCAGAGTTATCCTCAATT | 52 | 3950 |
| 522846 | 31939 | 31958 | CTGCCAGAGTTATCCTCAAT | 62 | 3951 |
| 522847 | 31940 | 31959 | CCTGCCAGAGTTATCCTCAA | 64 | 3952 |
| 522848 | 31941 | 31960 | TCCTGCCAGAGTTATCCTCA | 68 | 3953 |
| 522849 | 31943 | 31962 | GATCCTGCCAGAGTTATCCT | 69 | 3954 |
| 522850 | 31944 | 31963 | GGATCCTGCCAGAGTTATCC | 62 | 3955 |
| 522851 | 31945 | 31964 | AGGATCCTGCCAGAGTTATC | 45 | 3956 |
| 522852 | 31946 | 31965 | CAGGATCCTGCCAGAGTTAT | 60 | 3957 |
| 522853 | 32116 | 32135 | CAGCAAATATACACCACCCT | 70 | 3958 |
| 522854 | 32117 | 32136 | ACAGCAAATATACACCACCC | 66 | 3959 |
| 522855 | 32118 | 32137 | AACAGCAAATATACACCACC | 56 | 3960 |
| 522856 | 32119 | 32138 | CAACAGCAAATATACACCAC | 66 | 3961 |
| 522857 | 32121 | 32140 | CACAACAGCAAATATACACC | 70 | 3962 |
| 522858 | 32122 | 32141 | TCACAACAGCAAATATACAC | 55 | 3963 |
| 522859 | 32123 | 32142 | CTCACAACAGCAAATATACA | 41 | 3964 |
| 522860 | 32124 | 32143 | ACTCACAACAGCAAATATAC | 48 | 3965 |
| 522861 | 32126 | 32145 | TGACTCACAACAGCAAATAT | 21 | 3966 |
| 522862 | 32127 | 32146 | CTGACTCACAACAGCAAATA | 33 | 3967 |
| 522863 | 32128 | 32147 | ACTGACTCACAACAGCAAAT | 44 | 3968 |
| 522864 | 32129 | 32148 | CACTGACTCACAACAGCAAA | 54 | 3969 |
| 522865 | 32131 | 32150 | GTCACTGACTCACAACAGCA | 85 | 3970 |
| 522866 | 32132 | 32151 | AGTCACTGACTCACAACAGC | 80 | 3971 |
| 522867 | 32133 | 32152 | CAGTCACTGACTCACAACAG | 62 | 3972 |

TABLE 57-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522868 | 32134 | 32153 | TCAGTCACTGACTCACAACA | 62 | 3973 |
| 522869 | 32136 | 32155 | TCTCAGTCACTGACTCACAA | 71 | 3974 |
| 522870 | 32137 | 32156 | ATCTCAGTCACTGACTCACA | 77 | 3975 |
| 522871 | 32138 | 32157 | GATCTCAGTCACTGACTCAC | 75 | 3976 |
| 522872 | 32139 | 32158 | GGATCTCAGTCACTGACTCA | 73 | 3977 |
| 522873 | 32173 | 32192 | GGTTACCCAGCCACTGCCCC | 65 | 3978 |
| 522874 | 32174 | 32193 | GGGTTACCCAGCCACTGCCC | 54 | 3979 |
| 522875 | 32175 | 32194 | AGGGTTACCCAGCCACTGCC | 61 | 3980 |
| 522876 | 32176 | 32195 | CAGGGTTACCCAGCCACTGC | 65 | 3981 |
| 522877 | 32178 | 32197 | TGCAGGGTTACCCAGCCACT | 74 | 3982 |
| 522878 | 32179 | 32198 | ATGCAGGGTTACCCAGCCAC | 73 | 3983 |
| 522879 | 32180 | 32199 | GATGCAGGGTTACCCAGCCA | 67 | 3984 |
| 522880 | 32181 | 32200 | GGATGCAGGGTTACCCAGCC | 69 | 3985 |
| 522881 | 32183 | 32202 | AAGGATGCAGGGTTACCCAG | 58 | 3986 |
| 522882 | 32184 | 32203 | GAAGGATGCAGGGTTACCCA | 58 | 3987 |
| 522883 | 32185 | 32204 | TGAAGGATGCAGGGTTACCC | 51 | 3988 |
| 522884 | 32186 | 32205 | GTGAAGGATGCAGGGTTACC | 43 | 3989 |
| 413433 | 32431 | 32450 | GCCTGGACAAGTCCTGCCCA | 80 | 425 |
| 522885 | 33409 | 33428 | ATCTTCATTACATGATTACT | 59 | 3990 |
| 522886 | 33410 | 33429 | GATCTTCATTACATGATTAC | 58 | 3991 |
| 522887 | 33411 | 33430 | AGATCTTCATTACATGATTA | 69 | 3992 |
| 522888 | 33412 | 33431 | CAGATCTTCATTACATGATT | 81 | 3993 |
| 522889 | 33414 | 33433 | GGCAGATCTTCATTACATGA | 83 | 3994 |
| 522890 | 33669 | 33688 | ATGGACAGGTGATTCTAAGC | 69 | 3995 |
| 522891 | 33670 | 33689 | GATGGACAGGTGATTCTAAG | 56 | 3996 |
| 522892 | 33672 | 33691 | CAGATGGACAGGTGATTCTA | 62 | 3997 |
| 522893 | 33674 | 33693 | GGCAGATGGACAGGTGATTC | 67 | 3998 |
| 522894 | 33675 | 33694 | AGGCAGATGGACAGGTGATT | 76 | 3999 |
| 522895 | 33676 | 33695 | GAGGCAGATGGACAGGTGAT | 69 | 4000 |
| 522896 | 33677 | 33696 | TGAGGCAGATGGACAGGTGA | 50 | 4001 |
| 522897 | 33730 | 33749 | GTGACCTTGGGATAGTCCCT | 88 | 4002 |
| 522898 | 33731 | 33750 | TGTGACCTTGGGATAGTCCC | 76 | 4003 |
| 522899 | 33732 | 33751 | TTGTGACCTTGGGATAGTCC | 69 | 4004 |
| 522900 | 33733 | 33752 | TTTGTGACCTTGGGATAGTC | 52 | 4005 |
| 522901 | 33857 | 33876 | GAGCAAAGGCTTGCTTAAGT | 60 | 4006 |

TABLE 58

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 413433 | 32431 | 32450 | GCCTGGACAAGTCCTGCCCA | 77 | 425 |
| 522902 | 33858 | 33877 | AGAGCAAAGGCTTGCTTAAG | 40 | 4007 |
| 522903 | 33859 | 33878 | AAGAGCAAAGGCTTGCTTAA | 41 | 4008 |
| 522904 | 33860 | 33879 | GAAGAGCAAAGGCTTGCTTA | 67 | 4009 |
| 522905 | 33862 | 33881 | CAGAAGAGCAAAGGCTTGCT | 74 | 4010 |
| 522906 | 33863 | 33882 | ACAGAAGAGCAAAGGCTTGC | 61 | 4011 |
| 522907 | 33864 | 33883 | CACAGAAGAGCAAAGGCTTG | 33 | 4012 |
| 522908 | 33865 | 33884 | CCACAGAAGAGCAAAGGCTT | 58 | 4013 |
| 522909 | 33867 | 33886 | ACCCACAGAAGAGCAAAGGC | 63 | 4014 |
| 522910 | 33868 | 33887 | GACCCACAGAAGAGCAAAGG | 40 | 4015 |
| 522911 | 33869 | 33888 | AGACCCACAGAAGAGCAAAG | 37 | 4016 |
| 522912 | 33870 | 33889 | CAGACCCACAGAAGAGCAAA | 37 | 4017 |
| 522913 | 34212 | 34231 | ATGCCCTTGCTGTAGGACCC | 84 | 4018 |
| 522914 | 34213 | 34232 | AATGCCCTTGCTGTAGGACC | 69 | 4019 |
| 522915 | 34214 | 34233 | CAATGCCCTTGCTGTAGGAC | 59 | 4020 |
| 522916 | 34215 | 34234 | TCAATGCCCTTGCTGTAGGA | 56 | 4021 |
| 522917 | 34740 | 34759 | TTAGCTCTCAGTGAAGCTGG | 76 | 4022 |
| 522918 | 34869 | 34888 | AACAGCAGCAGTCTAATCCA | 49 | 4023 |
| 522919 | 34870 | 34889 | AAACAGCAGCAGTCTAATCC | 50 | 4024 |
| 522920 | 34871 | 34890 | GAAACAGCAGCAGTCTAATC | 30 | 4025 |
| 522921 | 34872 | 34891 | GGAAACAGCAGCAGTCTAAT | 33 | 4026 |
| 522922 | 34899 | 34918 | AACTCTCAGCTACTCCCCAA | 46 | 4027 |
| 522923 | 34900 | 34919 | CAACTCTCAGCTACTCCCCA | 56 | 4028 |
| 522924 | 34901 | 34920 | CCAACTCTCAGCTACTCCCC | 75 | 4029 |
| 522925 | 34902 | 34921 | ACCAACTCTCAGCTACTCCC | 75 | 4030 |
| 522926 | 34932 | 34951 | GCAAACAGATTAAAGTTGCT | 55 | 4031 |
| 522927 | 34933 | 34952 | GGCAAACAGATTAAAGTTGC | 63 | 4032 |
| 522928 | 35274 | 35293 | CACCTGAGTGCTGCAAAGTG | 47 | 4033 |
| 522929 | 35275 | 35294 | CCACCTGAGTGCTGCAAAGT | 55 | 4034 |
| 522930 | 35276 | 35295 | CCCACCTGAGTGCTGCAAAG | 58 | 4035 |
| 522931 | 35277 | 35296 | TCCCACCTGAGTGCTGCAAA | 60 | 4036 |
| 522932 | 35279 | 35298 | ACTCCCACCTGAGTGCTGCA | 77 | 4037 |
| 522933 | 35280 | 35299 | CACTCCCACCTGAGTGCTGC | 62 | 4038 |
| 522934 | 35281 | 35300 | ACACTCCCACCTGAGTGCTG | 64 | 4039 |
| 522935 | 35282 | 35301 | GACACTCCCACCTGAGTGCT | 69 | 4040 |
| 522936 | 35319 | 35338 | TTTTTGGCTGCCCTGCCTCA | 35 | 4041 |

TABLE 58-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522937 | 35320 | 35339 | CTTTTTGGCTGCCCTGCCTC | 56 | 4042 |
| 522938 | 35321 | 35340 | TCTTTTTGGCTGCCCTGCCT | 58 | 4043 |
| 522939 | 35322 | 35341 | GTCTTTTTGGCTGCCCTGCC | 74 | 4044 |
| 522940 | 35324 | 35343 | TGGTCTTTTTGGCTGCCCTG | 72 | 4045 |
| 522941 | 35325 | 35344 | TTGGTCTTTTTGGCTGCCCT | 79 | 4046 |
| 522942 | 35326 | 35345 | GTTGGTCTTTTTGGCTGCCC | 81 | 4047 |
| 522943 | 35327 | 35346 | CGTTGGTCTTTTTGGCTGCC | 79 | 4048 |
| 522944 | 35407 | 35426 | CTTATCTTTGTCCACATATC | 57 | 4049 |
| 522945 | 35408 | 35427 | CCTTATCTTTGTCCACATAT | 66 | 4050 |
| 522946 | 35409 | 35428 | ACCTTATCTTTGTCCACATA | 60 | 4051 |
| 522947 | 35410 | 35429 | TACCTTATCTTTGTCCACAT | 75 | 4052 |
| 522948 | 35412 | 35431 | AATACCTTATCTTTGTCCAC | 67 | 4053 |
| 522949 | 35413 | 35432 | AAATACCTTATCTTTGTCCA | 61 | 4054 |
| 522950 | 35414 | 35433 | TAAATACCTTATCTTTGTCC | 71 | 4055 |
| 522951 | 35415 | 35434 | ATAAATACCTTATCTTTGTC | 16 | 4056 |
| 522952 | 35417 | 35436 | CAATAAATACCTTATCTTTG | 22 | 4057 |
| 522953 | 35418 | 35437 | TCAATAAATACCTTATCTTT | 3 | 4058 |
| 522954 | 35419 | 35438 | TTCAATAAATACCTTATCTT | 12 | 4059 |
| 522955 | 35420 | 35439 | CTTCAATAAATACCTTATCT | 47 | 4060 |
| 522956 | 35422 | 35441 | TGCTTCAATAAATACCTTAT | 65 | 4061 |
| 522957 | 35423 | 35442 | ATGCTTCAATAAATACCTTA | 55 | 4062 |
| 522958 | 35424 | 35443 | AATGCTTCAATAAATACCTT | 42 | 4063 |
| 522959 | 35425 | 35444 | TAATGCTTCAATAAATACCT | 42 | 4064 |
| 522960 | 35432 | 35451 | TTAGAAGTAATGCTTCAATA | 37 | 4065 |
| 522961 | 35433 | 35452 | CTTAGAAGTAATGCTTCAAT | 44 | 4066 |
| 522962 | 35434 | 35453 | TCTTAGAAGTAATGCTTCAA | 44 | 4067 |
| 522963 | 35435 | 35454 | CTCTTAGAAGTAATGCTTCA | 59 | 4068 |
| 522964 | 35437 | 35456 | CCCTCTTAGAAGTAATGCTT | 80 | 4069 |
| 522965 | 35438 | 35457 | TCCCTCTTAGAAGTAATGCT | 73 | 4070 |
| 522966 | 35439 | 35458 | TTCCCTCTTAGAAGTAATGC | 59 | 4071 |
| 522967 | 35440 | 35459 | TTTCCCTCTTAGAAGTAATG | 48 | 4072 |
| 522968 | 37835 | 37854 | GCTAATGATACAAGGTTGTT | 57 | 4073 |
| 522969 | 37836 | 37855 | AGCTAATGATACAAGGTTGT | 54 | 4074 |
| 522970 | 37838 | 37857 | GCAGCTAATGATACAAGGTT | 65 | 4075 |
| 522971 | 37840 | 37859 | ATGCAGCTAATGATACAAGG | 57 | 4076 |

TABLE 58-continued

Inhibition of DGAT2 mRNA by 5-10-5 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 522972 | 37841 | 37860 | AATGCAGCTAATGATACAAG | 33 | 4077 |
| 522973 | 37842 | 37861 | AAATGCAGCTAATGATACAA | 24 | 4078 |
| 522974 | 37843 | 37862 | AAAATGCAGCTAATGATACA | 22 | 4079 |
| 522975 | 39666 | 39685 | AAGAGTTACCTCCTCCCTGG | 30 | 4080 |
| 522976 | 39667 | 39686 | CAAGAGTTACCTCCTCCCTG | 36 | 4081 |
| 522977 | 39668 | 39687 | GCAAGAGTTACCTCCTCCCT | 62 | 4082 |
| 522978 | 39669 | 39688 | TGCAAGAGTTACCTCCTCCC | 61 | 4083 |

TABLE 59

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525386 | 10047 | 10063 | CCACAGGGCCCTTTCCA | 49 | 4141 |
| 525387 | 10048 | 10064 | GCCACAGGGCCCTTTCC | 53 | 4142 |
| 525388 | 10215 | 10231 | GTTCTCGAATATCCCTA | 67 | 4143 |
| 525389 | 10216 | 10232 | AGTTCTCGAATATCCCT | 55 | 4144 |
| 525390 | 10217 | 10233 | GAGTTCTCGAATATCCC | 52 | 4145 |
| 525391 | 10218 | 10234 | GGAGTTCTCGAATATCC | 60 | 4146 |
| 525392 | 10219 | 10235 | AGGAGTTCTCGAATATC | 34 | 4147 |
| 525393 | 10220 | 10236 | GAGGAGTTCTCGAATAT | 41 | 4148 |
| 525394 | 10490 | 10506 | GGTCCTCTCCGCTGCCT | 62 | 4149 |
| 525395 | 10491 | 10507 | GGGTCCTCTCCGCTGCC | 70 | 4150 |
| 525396 | 10492 | 10508 | AGGGTCCTCTCCGCTGC | 57 | 4151 |
| 525397 | 10529 | 10545 | TTCACTGAGGACCTCAG | 29 | 4152 |
| 525398 | 10530 | 10546 | ATTCACTGAGGACCTCA | 44 | 4153 |
| 525399 | 10531 | 10547 | GATTCACTGAGGACCTC | 66 | 4154 |
| 525400 | 10532 | 10548 | CGATTCACTGAGGACCT | 48 | 4155 |
| 525401 | 10533 | 10549 | GCGATTCACTGAGGACC | 83 | 4156 |
| 525402 | 10534 | 10550 | CGCGATTCACTGAGGAC | 71 | 4157 |
| 525403 | 10535 | 10551 | GCGCGATTCACTGAGGA | 68 | 4158 |
| 525404 | 10536 | 10552 | TGCGCGATTCACTGAGG | 65 | 4159 |
| 525405 | 10537 | 10553 | CTGCGCGATTCACTGAG | 60 | 4160 |
| 525406 | 10538 | 10554 | TCTGCGCGATTCACTGA | 45 | 4161 |
| 525407 | 10650 | 10666 | TCCTCCCACTTCAGTTT | 28 | 4162 |

TABLE 59-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525408 | 10651 | 10667 | TTCCTCCCACTTCAGTT | 18 | 4163 |
| 525409 | 10652 | 10668 | CTTCCTCCCACTTCAGT | 30 | 4164 |
| 525410 | 10654 | 10670 | TGCTTCCTCCCACTTCA | 30 | 4165 |
| 525411 | 10655 | 10671 | ATGCTTCCTCCCACTTC | 37 | 4166 |
| 525412 | 10656 | 10672 | CATGCTTCCTCCCACTT | 32 | 4167 |
| 525413 | 10657 | 10673 | GCATGCTTCCTCCCACT | 59 | 4168 |
| 525414 | 10658 | 10674 | GGCATGCTTCCTCCCAC | 69 | 4169 |
| 525415 | 10659 | 10675 | AGGCATGCTTCCTCCCA | 71 | 4170 |
| 525416 | 10660 | 10676 | TAGGCATGCTTCCTCCC | 62 | 4171 |
| 525417 | 10661 | 10677 | TTAGGCATGCTTCCTCC | 53 | 4172 |
| 525418 | 10662 | 10678 | CTTAGGCATGCTTCCTC | 53 | 4173 |
| 525419 | 10663 | 10679 | ACTTAGGCATGCTTCCT | 63 | 4174 |
| 525420 | 10664 | 10680 | AACTTAGGCATGCTTCC | 62 | 4175 |
| 525421 | 10665 | 10681 | AAACTTAGGCATGCTTC | 50 | 4176 |
| 525422 | 10666 | 10682 | AAAACTTAGGCATGCTT | 58 | 4177 |
| 525423 | 10667 | 10683 | GAAAACTTAGGCATGCT | 68 | 4178 |
| 525424 | 10668 | 10684 | GGAAAACTTAGGCATGC | 65 | 4179 |
| 525425 | 10669 | 10685 | AGGAAAACTTAGGCATG | 41 | 4180 |
| 525426 | 10670 | 10686 | AAGGAAAACTTAGGCAT | 15 | 4181 |
| 525427 | 10671 | 10687 | TAAGGAAAACTTAGGCA | 15 | 4182 |
| 525428 | 10672 | 10688 | CTAAGGAAAACTTAGGC | 12 | 4183 |
| 525429 | 10728 | 10744 | GATGACTTCCCAGGGTC | 32 | 4184 |
| 525430 | 10729 | 10745 | TGATGACTTCCCAGGGT | 41 | 4185 |
| 525431 | 10730 | 10746 | GTGATGACTTCCCAGGG | 78 | 4186 |
| 525432 | 10731 | 10747 | TGTGATGACTTCCCAGG | 51 | 4187 |
| 525433 | 10732 | 10748 | CTGTGATGACTTCCCAG | 41 | 4188 |
| 525434 | 10733 | 10749 | GCTGTGATGACTTCCCA | 63 | 4189 |
| 525435 | 10734 | 10750 | AGCTGTGATGACTTCCC | 61 | 4190 |
| 525436 | 10735 | 10751 | CAGCTGTGATGACTTCC | 60 | 4191 |
| 525437 | 10736 | 10752 | ACAGCTGTGATGACTTC | 31 | 4192 |
| 525438 | 10737 | 10753 | GACAGCTGTGATGACTT | 0 | 4193 |
| 525439 | 10816 | 10832 | TGTCAGAGAGGCTCAGC | 59 | 4194 |
| 525440 | 10817 | 10833 | ATGTCAGAGAGGCTCAG | 41 | 4195 |
| 525441 | 10818 | 10834 | CATGTCAGAGAGGCTCA | 60 | 4196 |
| 525442 | 10819 | 10835 | CCATGTCAGAGAGGCTC | 73 | 4197 |
| 525443 | 10820 | 10836 | TCCATGTCAGAGAGGCT | 75 | 4198 |

TABLE 59-continued

Inhibition of DGAT2 mRNA by 3-10-4 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525444 | 10821 | 10837 | ATCCATGTCAGAGAGGC | 64 | 4199 |
| 525445 | 10822 | 10838 | AATCCATGTCAGAGAGG | 44 | 4200 |
| 525446 | 10823 | 10839 | AAATCCATGTCAGAGAG | 10 | 4201 |
| 525447 | 10940 | 10956 | TAGTCGATTTACCAGAA | 31 | 4202 |
| 525448 | 10941 | 10957 | ATAGTCGATTTACCAGA | 31 | 4203 |
| 525449 | 10942 | 10958 | GATAGTCGATTTACCAG | 43 | 4204 |
| 525450 | 10943 | 10959 | GGATAGTCGATTTACCA | 62 | 4205 |
| 525451 | 10944 | 10960 | TGGATAGTCGATTTACC | 48 | 4206 |
| 525452 | 10945 | 10961 | TTGGATAGTCGATTTAC | 36 | 4207 |
| 525453 | 10946 | 10962 | TTTGGATAGTCGATTTA | 16 | 4208 |
| 525454 | 11074 | 11090 | CGATGTTACATTAAGGG | 26 | 4209 |
| 525455 | 11075 | 11091 | TCGATGTTACATTAAGG | 24 | 4210 |
| 525456 | 11076 | 11092 | CTCGATGTTACATTAAG | 11 | 4211 |
| 496041 | 31122 | 31138 | CACAGCGATGAGCCAGC | 52 | 1096 |
| 413433 | 32431 | 32450 | GCCTGGACAAGTCCTGCCCA | 69 | 425 |
| 525765 | 36860 | 36876 | ATTATTCTAAAACTCAA | 11 | 4212 |
| 525766 | 36861 | 36877 | GATTATTCTAAAACTCA | 6 | 4213 |
| 525767 | 36862 | 36878 | TGATTATTCTAAAACTC | 7 | 4214 |
| 525768 | 37022 | 37038 | GGGCAGTCACCATTTGC | 14 | 4215 |
| 525769 | 37023 | 37039 | TGGGCAGTCACCATTTG | 12 | 4216 |
| 525770 | 37024 | 37040 | TTGGGCAGTCACCATTT | 7 | 4217 |

TABLE 60

Inhibition of DGAT2 mRNA by 3-10-4 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525457 | 11077 | 11093 | CCTCGATGTTACATTAA | 44 | 4218 |
| 525458 | 11127 | 11143 | TATTGCAACCACTAGGA | 36 | 4219 |
| 525459 | 11128 | 11144 | TTATTGCAACCACTAGG | 41 | 4220 |
| 525460 | 11129 | 11145 | GTTATTGCAACCACTAG | 49 | 4221 |
| 525461 | 11130 | 11146 | GGTTATTGCAACCACTA | 61 | 4222 |
| 525462 | 11158 | 11174 | AGTTAAAGTGTGGTACA | 4 | 4223 |
| 525463 | 11159 | 11175 | CAGTTAAAGTGTGGTAC | 37 | 4224 |
| 525464 | 11160 | 11176 | ACAGTTAAAGTGTGGTA | 14 | 4225 |
| 525465 | 11171 | 11187 | ATGCCTAGGTCACAGTT | 55 | 4226 |

TABLE 60-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525466 | 11172 | 11188 | AATGCCTAGGTCACAGT | 48 | 4227 |
| 525467 | 11173 | 11189 | CAATGCCTAGGTCACAG | 44 | 4228 |
| 525468 | 11174 | 11190 | CCAATGCCTAGGTCACA | 73 | 4229 |
| 525469 | 11175 | 11191 | GCCAATGCCTAGGTCAC | 89 | 4230 |
| 525470 | 11176 | 11192 | TGCCAATGCCTAGGTCA | 82 | 4231 |
| 525471 | 11177 | 11193 | ATGCCAATGCCTAGGTC | 79 | 4232 |
| 525472 | 11178 | 11194 | AATGCCAATGCCTAGGT | 76 | 4233 |
| 525473 | 11179 | 11195 | CAATGCCAATGCCTAGG | 69 | 4234 |
| 525474 | 11180 | 11196 | GCAATGCCAATGCCTAG | 78 | 4235 |
| 525475 | 11199 | 11215 | AGCGATAATCACACAAG | 54 | 4236 |
| 525476 | 11200 | 11216 | CAGCGATAATCACACAA | 58 | 4237 |
| 525477 | 11201 | 11217 | ACAGCGATAATCACACA | 72 | 4238 |
| 525478 | 11202 | 11218 | CACAGCGATAATCACAC | 49 | 4239 |
| 525479 | 11203 | 11219 | CCACAGCGATAATCACA | 79 | 4240 |
| 525480 | 11204 | 11220 | ACCACAGCGATAATCAC | 76 | 4241 |
| 525481 | 11205 | 11221 | AACCACAGCGATAATCA | 40 | 4242 |
| 525482 | 14503 | 14519 | GGTCTGCCACTCTCTAC | 49 | 4243 |
| 525483 | 14504 | 14520 | GGGTCTGCCACTCTCTA | 47 | 4244 |
| 525484 | 14505 | 14521 | AGGGTCTGCCACTCTCT | 64 | 4245 |
| 525485 | 14648 | 14664 | AGTCATCTTGTGTACAT | 60 | 4246 |
| 525486 | 14649 | 14665 | CAGTCATCTTGTGTACA | 49 | 4247 |
| 525487 | 14650 | 14666 | ACAGTCATCTTGTGTAC | 52 | 4248 |
| 525488 | 14663 | 14679 | CAGATCACTCTGCACAG | 62 | 4249 |
| 525489 | 14664 | 14680 | TCAGATCACTCTGCACA | 65 | 4250 |
| 525490 | 14665 | 14681 | CTCAGATCACTCTGCAC | 61 | 4251 |
| 525491 | 14667 | 14683 | TGCTCAGATCACTCTGC | 60 | 4252 |
| 525492 | 14668 | 14684 | TTGCTCAGATCACTCTG | 51 | 4253 |
| 525493 | 14669 | 14685 | ATTGCTCAGATCACTCT | 54 | 4254 |
| 525494 | 14745 | 14761 | ACCTCTTCCAGGAAGAC | 41 | 4255 |
| 525495 | 14746 | 14762 | CACCTCTTCCAGGAAGA | 44 | 4256 |
| 525496 | 14747 | 14763 | TCACCTCTTCCAGGAAG | 28 | 4257 |
| 525497 | 14755 | 14771 | ACTGAATGTCACCTCTT | 57 | 4258 |
| 525498 | 14756 | 14772 | GACTGAATGTCACCTCT | 62 | 4259 |
| 525499 | 14757 | 14773 | GGACTGAATGTCACCTC | 71 | 4260 |
| 525500 | 14758 | 14774 | CGGACTGAATGTCACCT | 74 | 4261 |
| 525501 | 14759 | 14775 | CCGGACTGAATGTCACC | 80 | 4262 |

TABLE 60-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525502 | 14760 | 14776 | TCCGGACTGAATGTCAC | 39 | 4263 |
| 525503 | 14770 | 14786 | TCTTTCCAGATCCGGAC | 53 | 4264 |
| 525504 | 14771 | 14787 | ATCTTTCCAGATCCGGA | 62 | 4265 |
| 525505 | 14772 | 14788 | CATCTTTCCAGATCCGG | 70 | 4266 |
| 525506 | 14773 | 14789 | TCATCTTTCCAGATCCG | 71 | 4267 |
| 525507 | 14774 | 14790 | TTCATCTTTCCAGATCC | 63 | 4268 |
| 525508 | 14775 | 14791 | ATTCATCTTTCCAGATC | 23 | 4269 |
| 525509 | 14996 | 15012 | TCTCAAGTCTTCCTCCT | 33 | 4270 |
| 525510 | 14997 | 15013 | CTCTCAAGTCTTCCTCC | 46 | 4271 |
| 525511 | 14998 | 15014 | GCTCTCAAGTCTTCCTC | 65 | 4272 |
| 525512 | 14999 | 15015 | AGCTCTCAAGTCTTCCT | 72 | 4273 |
| 525513 | 15000 | 15016 | GAGCTCTCAAGTCTTCC | 73 | 4274 |
| 525514 | 15001 | 15017 | TGAGCTCTCAAGTCTTC | 64 | 4275 |
| 525515 | 15250 | 15266 | ATAATCTGCACAGGTTC | 72 | 4276 |
| 525516 | 15251 | 15267 | CATAATCTGCACAGGTT | 67 | 4277 |
| 525517 | 15252 | 15268 | CCATAATCTGCACAGGT | 69 | 4278 |
| 525518 | 15253 | 15269 | ACCATAATCTGCACAGG | 68 | 4279 |
| 525519 | 15254 | 15270 | CACCATAATCTGCACAG | 49 | 4280 |
| 525520 | 15255 | 15271 | GCACCATAATCTGCACA | 60 | 4281 |
| 525521 | 18156 | 18172 | TTAATCCAGGATTGTCA | 55 | 4282 |
| 525522 | 18157 | 18173 | TTTAATCCAGGATTGTC | 57 | 4283 |
| 525523 | 18158 | 18174 | CTTTAATCCAGGATTGT | 26 | 4284 |
| 525524 | 18161 | 18177 | TAGCTTTAATCCAGGAT | 42 | 4285 |
| 525525 | 18162 | 18178 | TTAGCTTTAATCCAGGA | 28 | 4286 |
| 525526 | 18163 | 18179 | CTTAGCTTTAATCCAGG | 45 | 4287 |
| 525527 | 18164 | 18180 | CCTTAGCTTTAATCCAG | 27 | 4288 |
| 525528 | 18165 | 18181 | TCCTTAGCTTTAATCCA | 60 | 4289 |
| 525529 | 18166 | 18182 | CTCCTTAGCTTTAATCC | 23 | 4290 |
| 525530 | 18167 | 18183 | CCTCCTTAGCTTTAATC | 32 | 4291 |
| 525531 | 18168 | 18184 | TCCTCCTTAGCTTTAAT | 28 | 4292 |
| 525532 | 18174 | 18190 | TCAGTGTCCTCCTTAGC | 39 | 4293 |
| 525533 | 18175 | 18191 | CTCAGTGTCCTCCTTAG | 32 | 4294 |
| 496041 | 31122 | 31138 | CACAGCGATGAGCCAGC | 64 | 1096 |
| 413433 | 32431 | 32450 | GCCTGGACAAGTCCTGCCCA | 78 | 425 |

TABLE 61

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525534 | 18176 | 18192 | ACTCAGTGTCCTCCTTA | 35 | 4295 |
| 525535 | 18177 | 18193 | GACTCAGTGTCCTCCTT | 64 | 4296 |
| 525536 | 18178 | 18194 | GGACTCAGTGTCCTCCT | 73 | 4297 |
| 525537 | 18180 | 18196 | TGGGACTCAGTGTCCTC | 62 | 4298 |
| 525538 | 18181 | 18197 | CTGGGACTCAGTGTCCT | 59 | 4299 |
| 525539 | 18182 | 18198 | CCTGGGACTCAGTGTCC | 63 | 4300 |
| 525540 | 18308 | 18324 | CTGTTTGATGGGTAAAA | 20 | 4301 |
| 525541 | 18309 | 18325 | CCTGTTTGATGGGTAAA | 62 | 4302 |
| 525542 | 18310 | 18326 | TCCTGTTTGATGGGTAA | 68 | 4303 |
| 525543 | 18311 | 18327 | CTCCTGTTTGATGGGTA | 39 | 4304 |
| 525544 | 18312 | 18328 | TCTCCTGTTTGATGGGT | 73 | 4305 |
| 525545 | 18313 | 18329 | CTCTCCTGTTTGATGGG | 47 | 4306 |
| 525546 | 18314 | 18330 | CCTCTCCTGTTTGATGG | 43 | 4307 |
| 525547 | 18321 | 18337 | TCGGTGTCCTCTCCTGT | 63 | 4308 |
| 525548 | 18322 | 18338 | CTCGGTGTCCTCTCCTG | 64 | 4309 |
| 525549 | 18323 | 18339 | CCTCGGTGTCCTCTCCT | 60 | 4310 |
| 525550 | 18324 | 18340 | GCCTCGGTGTCCTCTCC | 68 | 4311 |
| 525551 | 18325 | 18341 | AGCCTCGGTGTCCTCTC | 78 | 4312 |
| 525552 | 18326 | 18342 | AAGCCTCGGTGTCCTCT | 73 | 4313 |
| 525553 | 18327 | 18343 | TAAGCCTCGGTGTCCTC | 70 | 4314 |
| 525554 | 18328 | 18344 | GTAAGCCTCGGTGTCCT | 75 | 4315 |
| 525555 | 18329 | 18345 | AGTAAGCCTCGGTGTCC | 64 | 4316 |
| 525556 | 18417 | 18433 | CCAGATTGTTGTGGGAA | 66 | 4317 |
| 525557 | 18418 | 18434 | ACCAGATTGTTGTGGGA | 68 | 4318 |
| 525558 | 18419 | 18435 | CACCAGATTGTTGTGGG | 63 | 4319 |
| 525559 | 18432 | 18448 | CTAATACCTACCTCACC | 35 | 4320 |
| 525560 | 18433 | 18449 | GCTAATACCTACCTCAC | 25 | 4321 |
| 525561 | 18434 | 18450 | GGCTAATACCTACCTCA | 34 | 4322 |
| 525562 | 18450 | 18466 | CTCATCTATACAGTGGG | 58 | 4323 |
| 525563 | 18451 | 18467 | CCTCATCTATACAGTGG | 51 | 4324 |
| 525564 | 18452 | 18468 | TCCTCATCTATACAGTG | 28 | 4325 |
| 525565 | 18581 | 18597 | ACTGGCATCTGGCAGGG | 69 | 4326 |
| 525566 | 18582 | 18598 | TACTGGCATCTGGCAGG | 52 | 4327 |
| 525567 | 18583 | 18599 | ATACTGGCATCTGGCAG | 31 | 4328 |
| 525568 | 18591 | 18607 | TCACCTCCATACTGGCA | 21 | 4329 |
| 525569 | 18592 | 18608 | CTCACCTCCATACTGGC | 20 | 4330 |

TABLE 61-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525570 | 18593 | 18609 | CCTCACCTCCATACTGG | 6 | 4331 |
| 525571 | 18828 | 18844 | ATGCTTAACTTCTGCTG | 48 | 4332 |
| 525572 | 18829 | 18845 | GATGCTTAACTTCTGCT | 46 | 4333 |
| 525573 | 18830 | 18846 | GGATGCTTAACTTCTGC | 53 | 4334 |
| 525574 | 18831 | 18847 | AGGATGCTTAACTTCTG | 40 | 4335 |
| 525575 | 18832 | 18848 | TAGGATGCTTAACTTCT | 40 | 4336 |
| 525576 | 18833 | 18849 | TTAGGATGCTTAACTTC | 20 | 4337 |
| 525577 | 18869 20779 | 18885 20795 | GGCCTGGATGCCCAAGT | 65 | 4338 |
| 525578 | 18870 20780 | 18886 20796 | AGGCCTGGATGCCCAAG | 71 | 4339 |
| 525579 | 18871 20781 | 18887 20797 | TAGGCCTGGATGCCCAA | 66 | 4340 |
| 525580 | 18900 | 18916 | CAGATGATGTCCTGCCT | 25 | 4341 |
| 525581 | 18901 | 18917 | GCAGATGATGTCCTGCC | 55 | 4342 |
| 525582 | 18902 | 18918 | AGCAGATGATGTCCTGC | 38 | 4343 |
| 525583 | 19018 | 19034 | TAGTCAAAGGTGGCTTC | 44 | 4344 |
| 525584 | 19019 | 19035 | GTAGTCAAAGGTGGCTT | 57 | 4345 |
| 525585 | 19020 | 19036 | AGTAGTCAAAGGTGGCT | 55 | 4346 |
| 525589 | 22548 | 22564 | AACAAGTGGGAAATGCA | 17 | 4347 |
| 525590 | 22549 | 22565 | CAACAAGTGGGAAATGC | 19 | 4348 |
| 525591 | 22550 | 22566 | CCAACAAGTGGGAAATG | 23 | 4349 |
| 525592 | 22771 | 22787 | AGCTTATTAGGTGTCTT | 42 | 4350 |
| 525593 | 22772 | 22788 | AAGCTTATTAGGTGTCT | 53 | 4351 |
| 525594 | 22773 | 22789 | TAAGCTTATTAGGTGTC | 44 | 4352 |
| 525595 | 22774 | 22790 | CTAAGCTTATTAGGTGT | 36 | 4353 |
| 525596 | 22886 | 22902 | CCCCCATGCAGCTTGGA | 29 | 4354 |
| 525597 | 22887 | 22903 | GCCCCCATGCAGCTTGG | 43 | 4355 |
| 525598 | 22888 | 22904 | AGCCCCCATGCAGCTTG | 50 | 4356 |
| 525599 | 23096 | 23112 | CCAAACACTCAGGTAGG | 49 | 4357 |
| 525600 | 23097 | 23113 | TCCAAACACTCAGGTAG | 41 | 4358 |
| 525601 | 23098 | 23114 | GTCCAAACACTCAGGTA | 54 | 4359 |
| 525602 | 23100 | 23116 | CAGTCCAAACACTCAGG | 47 | 4360 |
| 525603 | 23101 | 23117 | TCAGTCCAAACACTCAG | 57 | 4361 |
| 525604 | 23102 | 23118 | TTCAGTCCAAACACTCA | 49 | 4362 |
| 525605 | 23239 | 23255 | GAACAGCAGCATCAGCA | 47 | 4363 |
| 525606 | 23240 | 23256 | GGAACAGCAGCATCAGC | 67 | 4364 |
| 525607 | 23241 | 23257 | GGGAACAGCAGCATCAG | 40 | 4365 |

TABLE 61-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525608 | 23242 | 23258 | TGGGAACAGCAGCATCA | 44 | 4366 |
| 525609 | 23243 | 23259 | CTGGGAACAGCAGCATC | 69 | 4367 |
| 525610 | 23244 | 23260 | TCTGGGAACAGCAGCAT | 65 | 4368 |
| 525586 | 36855 | 36871 | TCTAAAACTCAAATCCA | 0 | 4369 |
| 525587 | 36856 | 36872 | TTCTAAAACTCAAATCC | 0 | 4370 |
| 525588 | 36857 | 36873 | ATTCTAAAACTCAAATC | 0 | 4371 |
| 496041 | 31122 | 31138 | CACAGCGATGAGCCAGC | 64 | 1096 |
| 413433 | 32431 | 32450 | GCCTGGACAAGTCCTGCCCA | 78 | 425 |

TABLE 62

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525611 | 23245 | 23261 | GTCTGGGAACAGCAGCA | 65 | 4372 |
| 525612 | 23246 | 23262 | GGTCTGGGAACAGCAGC | 83 | 4373 |
| 525613 | 23247 | 23263 | TGGTCTGGGAACAGCAG | 42 | 4374 |
| 525614 | 23427 | 23443 | ACAAGTCATCTTCCAGC | 16 | 4375 |
| 525615 | 23428 | 23444 | GACAAGTCATCTTCCAG | 24 | 4376 |
| 525616 | 23429 | 23445 | GGACAAGTCATCTTCCA | 37 | 4377 |
| 525617 | 23551 | 23567 | ATCCTTGAGGGTCTCAT | 55 | 4378 |
| 525618 | 23552 | 23568 | TATCCTTGAGGGTCTCA | 55 | 4379 |
| 525619 | 23553 | 23569 | TTATCCTTGAGGGTCTC | 65 | 4380 |
| 525620 | 23554 | 23570 | CTTATCCTTGAGGGTCT | 46 | 4381 |
| 525621 | 26400 | 26416 | CCTGGATGGCAACCTAA | 42 | 4382 |
| 525622 | 26401 | 26417 | GCCTGGATGGCAACCTA | 33 | 4383 |
| 525623 | 26402 | 26418 | GGCCTGGATGGCAACCT | 43 | 4384 |
| 525624 | 26484 | 26500 | CTGCTATGCTGAGAGCA | 44 | 4385 |
| 525625 | 26485 | 26501 | CCTGCTATGCTGAGAGC | 42 | 4386 |
| 525626 | 26486 | 26502 | ACCTGCTATGCTGAGAG | 8 | 4387 |
| 525627 | 26516 | 26532 | GTTCATCTGCCTTGACG | 44 | 4388 |
| 525628 | 26517 | 26533 | GGTTCATCTGCCTTGAC | 56 | 4389 |
| 525629 | 26518 | 26534 | AGGTTCATCTGCCTTGA | 33 | 4390 |
| 525630 | 26519 | 26535 | CAGGTTCATCTGCCTTG | 55 | 4391 |
| 525631 | 26520 | 26536 | GCAGGTTCATCTGCCTT | 75 | 4392 |

TABLE 62-continued

Inhibition of DGAT2 mRNA by 3-10-4 MOE
gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525632 | 26521 | 26537 | AGCAGGTTCATCTGCCT | 62 | 4393 |
| 525633 | 26536 | 26552 | TCTGTGATGCTCTGGAG | 33 | 4394 |
| 525634 | 26537 | 26553 | CTCTGTGATGCTCTGGA | 43 | 4395 |
| 525635 | 26538 | 26554 | ACTCTGTGATGCTCTGG | 46 | 4396 |
| 525636 | 26539 | 26555 | CACTCTGTGATGCTCTG | 39 | 4397 |
| 525637 | 26627 | 26643 | ACATGGTAAGTCCTGAT | 38 | 4398 |
| 525638 | 26628 | 26644 | GACATGGTAAGTCCTGA | 55 | 4399 |
| 525639 | 26629 | 26645 | TGACATGGTAAGTCCTG | 58 | 4400 |
| 525640 | 26630 | 26646 | CTGACATGGTAAGTCCT | 55 | 4401 |
| 525641 | 26631 | 26647 | ACTGACATGGTAAGTCC | 35 | 4402 |
| 525642 | 26632 | 26648 | CACTGACATGGTAAGTC | 48 | 4403 |
| 525643 | 26783 | 26799 | TCTGCCATTTAATGAGC | 19 | 4404 |
| 525644 | 26784 | 26800 | CTCTGCCATTTAATGAG | 22 | 4405 |
| 525645 | 26785 | 26801 | ACTCTGCCATTTAATGA | 12 | 4406 |
| 525646 | 26788 | 26804 | CCAACTCTGCCATTTAA | 43 | 4407 |
| 525647 | 26789 | 26805 | CCCAACTCTGCCATTTA | 47 | 4408 |
| 525648 | 26790 | 26806 | TCCCAACTCTGCCATTT | 35 | 4409 |
| 525649 | 26926 | 26942 | AGGGTTCATGGATCCCC | 69 | 4410 |
| 525650 | 26927 | 26943 | AAGGGTTCATGGATCCC | 67 | 4411 |
| 525651 | 26928 | 26944 | TAAGGGTTCATGGATCC | 44 | 4412 |
| 525652 | 27251 | 27267 | CTGGAGTCCCTGGGTTC | 45 | 4413 |
| 525653 | 27252 | 27268 | GCTGGAGTCCCTGGGTT | 30 | 4414 |
| 525654 | 27253 | 27269 | GGCTGGAGTCCCTGGGT | 31 | 4415 |
| 525655 | 27352 | 27368 | AGCCAGGCCCAGACCCA | 32 | 4416 |
| 525656 | 27353 | 27369 | CAGCCAGGCCCAGACCC | 22 | 4417 |
| 525657 | 27354 | 27370 | CCAGCCAGGCCCAGACC | 11 | 4418 |
| 525658 | 27382 | 27398 | GGTGTTCTACAAGCTGC | 61 | 4419 |
| 525659 | 27383 | 27399 | TGGTGTTCTACAAGCTG | 50 | 4420 |
| 525660 | 27384 | 27400 | CTGGTGTTCTACAAGCT | 49 | 4421 |
| 525661 | 27387 | 27403 | GAGCTGGTGTTCTACAA | 34 | 4422 |
| 525662 | 27388 | 27404 | TGAGCTGGTGTTCTACA | 47 | 4423 |
| 525663 | 27389 | 27405 | GTGAGCTGGTGTTCTAC | 55 | 4424 |
| 525664 | 27437 | 27453 | GATCAATTATTAACCTA | 14 | 4425 |
| 525665 | 27438 | 27454 | TGATCAATTATTAACCT | 0 | 4426 |
| 525666 | 27439 | 27455 | CTGATCAATTATTAACC | 5 | 4427 |
| 525667 | 29678 | 29694 | GCAGGTACTCATGTTTG | 50 | 4428 |

TABLE 62-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525668 | 29679 | 29695 | AGCAGGTACTCATGTTT | 39 | 4429 |
| 525669 | 29680 | 29696 | CAGCAGGTACTCATGTT | 31 | 4430 |
| 525670 | 29782 | 29798 | CCAATATCATACTATCT | 5 | 4431 |
| 525671 | 29783 | 29799 | CCCAATATCATACTATC | 13 | 4432 |
| 525672 | 29784 | 29800 | CCCCAATATCATACTAT | 40 | 4433 |
| 525673 | 29828 | 29844 | AACCTTTAAGGCCTATC | 16 | 4434 |
| 525674 | 29829 | 29845 | CAACCTTTAAGGCCTAT | 23 | 4435 |
| 525675 | 29830 | 29846 | CCAACCTTTAAGGCCTA | 35 | 4436 |
| 525676 | 29831 | 29847 | CCCAACCTTTAAGGCCT | 40 | 4437 |
| 525677 | 29839 | 29855 | ATTTTTTACCCAACCTT | 30 | 4438 |
| 525678 | 29840 | 29856 | CATTTTTTACCCAACCT | 24 | 4439 |
| 525679 | 29841 | 29857 | CCATTTTTTACCCAACC | 50 | 4440 |
| 525680 | 29842 | 29858 | TCCATTTTTTACCCAAC | 40 | 4441 |
| 525681 | 29843 | 29859 | TTCCATTTTTTACCCAA | 24 | 4442 |
| 525682 | 30483 | 30499 | GCTTTAGAAATTCACCA | 45 | 4443 |
| 525683 | 30484 | 30500 | GGCTTTAGAAATTCACC | 68 | 4444 |
| 525684 | 30485 | 30501 | AGGCTTTAGAAATTCAC | 39 | 4445 |
| 496041 | 31122 | 31138 | CACAGCGATGAGCCAGC | 58 | 1096 |
| 413433 | 32431 | 32450 | GCCTGGACAAGTCCTGCCCA | 76 | 425 |
| 525685 | 32431 | 32447 | TGGACAAGTCCTGCCCA | 47 | 4446 |
| 525686 | 32432 | 32448 | CTGGACAAGTCCTGCCC | 58 | 4447 |
| 525687 | 32433 | 32449 | CCTGGACAAGTCCTGCC | 60 | 4448 |

TABLE 63

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 496041 | 31122 | 31138 | CACAGCGATGAGCCAGC | 44 | 1096 |
| 413433 | 32431 | 32450 | GCCTGGACAAGTCCTGCCCA | 74 | 425 |
| 525688 | 32434 | 32450 | GCCTGGACAAGTCCTGC | 77 | 4449 |
| 525689 | 32435 | 32451 | AGCCTGGACAAGTCCTG | 50 | 4450 |
| 525690 | 32447 | 32463 | ACTAGACTATGCAGCCT | 62 | 4451 |
| 525691 | 32448 | 32464 | TACTAGACTATGCAGCC | 55 | 4452 |
| 525692 | 32449 | 32465 | ATACTAGACTATGCAGC | 37 | 4453 |
| 525693 | 32450 | 32466 | CATACTAGACTATGCAG | 17 | 4454 |

TABLE 63-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525694 | 32451 | 32467 | TCATACTAGACTATGCA | 20 | 4455 |
| 525695 | 32452 | 32468 | ATCATACTAGACTATGC | 20 | 4456 |
| 525696 | 32453 | 32469 | CATCATACTAGACTATG | 13 | 4457 |
| 525697 | 32454 | 32470 | CCATCATACTAGACTAT | 32 | 4458 |
| 525698 | 32455 | 32471 | GCCATCATACTAGACTA | 58 | 4459 |
| 525699 | 32456 | 32472 | TGCCATCATACTAGACT | 51 | 4460 |
| 525700 | 32457 | 32473 | TTGCCATCATACTAGAC | 40 | 4461 |
| 525701 | 32458 | 32474 | GTTGCCATCATACTAGA | 51 | 4462 |
| 525702 | 32460 | 32476 | ATGTTGCCATCATACTA | 52 | 4463 |
| 525703 | 32461 | 32477 | AATGTTGCCATCATACT | 28 | 4464 |
| 525704 | 32462 | 32478 | CAATGTTGCCATCATAC | 40 | 4465 |
| 525705 | 32463 | 32479 | GCAATGTTGCCATCATA | 73 | 4466 |
| 525706 | 32464 | 32480 | TGCAATGTTGCCATCAT | 62 | 4467 |
| 525707 | 32465 | 32481 | TTGCAATGTTGCCATCA | 61 | 4468 |
| 525708 | 32466 | 32482 | GTTGCAATGTTGCCATC | 79 | 4469 |
| 525709 | 32467 | 32483 | GGTTGCAATGTTGCCAT | 69 | 4470 |
| 525710 | 32468 | 32484 | TGGTTGCAATGTTGCCA | 66 | 4471 |
| 525711 | 32469 | 32485 | GTGGTTGCAATGTTGCC | 73 | 4472 |
| 525712 | 32470 | 32486 | GGTGGTTGCAATGTTGC | 45 | 4473 |
| 525713 | 32476 | 32492 | CTGGATGGTGGTTGCAA | 20 | 4474 |
| 525714 | 32477 | 32493 | CCTGGATGGTGGTTGCA | 59 | 4475 |
| 525715 | 32478 | 32494 | GCCTGGATGGTGGTTGC | 58 | 4476 |
| 525716 | 32479 | 32495 | AGCCTGGATGGTGGTTG | 34 | 4477 |
| 525717 | 32619 | 32635 | GAGATCTCCAGCAGCAA | 52 | 4478 |
| 525718 | 32620 | 32636 | TGAGATCTCCAGCAGCA | 57 | 4479 |
| 525719 | 32621 | 32637 | CTGAGATCTCCAGCAGC | 51 | 4480 |
| 525720 | 32622 | 32638 | ACTGAGATCTCCAGCAG | 16 | 4481 |
| 525721 | 32645 | 32661 | GGAGTGACAGGGCAGGA | 42 | 4482 |
| 525722 | 32646 | 32662 | TGGAGTGACAGGGCAGG | 42 | 4483 |
| 525723 | 32647 | 32663 | ATGGAGTGACAGGGCAG | 35 | 4484 |
| 525724 | 32752 | 32768 | AAGTCTATCAGGATGCA | 43 | 4485 |
| 525725 | 32753 | 32769 | AAAGTCTATCAGGATGC | 37 | 4486 |
| 525726 | 32754 | 32770 | CAAAGTCTATCAGGATG | 20 | 4487 |
| 525727 | 32755 | 32771 | ACAAAGTCTATCAGGAT | 0 | 4488 |
| 525728 | 32757 | 32773 | TGACAAAGTCTATCAGG | 25 | 4489 |
| 525729 | 32758 | 32774 | GTGACAAAGTCTATCAG | 51 | 4490 |

TABLE 63-continued

Inhibition of DGAT2 mRNA by 3-10-4 MOE gapmers targeting SEQ ID NO: 2

| ISIS NO | SEQ ID NO: 2 Start Site | SEQ ID NO: 2 Stop Site | Sequence | % inhibition | SEQ ID NO |
|---|---|---|---|---|---|
| 525730 | 32759 | 32775 | AGTGACAAAGTCTATCA | 28 | 4491 |
| 525731 | 33180 | 33196 | CCTAGTGCCCCAGGGAG | 29 | 4492 |
| 525732 | 33181 | 33197 | TCCTAGTGCCCCAGGGA | 25 | 4493 |
| 525733 | 33182 | 33198 | GTCCTAGTGCCCCAGGG | 74 | 4494 |
| 525734 | 33183 | 33199 | TGTCCTAGTGCCCCAGG | 53 | 4495 |
| 525735 | 36248 | 36264 | GGTATTCTGCTCATAAA | 43 | 4496 |
| 525736 | 36249 | 36265 | GGGTATTCTGCTCATAA | 50 | 4497 |
| 525737 | 36250 | 36266 | AGGGTATTCTGCTCATA | 65 | 4498 |
| 525738 | 36251 | 36267 | AAGGGTATTCTGCTCAT | 55 | 4499 |
| 525739 | 36252 | 36268 | TAAGGGTATTCTGCTCA | 58 | 4500 |
| 525740 | 36253 | 36269 | GTAAGGGTATTCTGCTC | 64 | 4501 |
| 525741 | 36254 | 36270 | AGTAAGGGTATTCTGCT | 60 | 4502 |
| 525742 | 36263 | 36279 | GAGACAATGAGTAAGGG | 25 | 4503 |
| 525743 | 36264 | 36280 | AGAGACAATGAGTAAGG | 19 | 4504 |
| 525744 | 36265 | 36281 | GAGAGACAATGAGTAAG | 11 | 4505 |
| 525745 | 36522 | 36538 | AAGCGACAGCCCTGTGC | 17 | 4506 |
| 525746 | 36523 | 36539 | CAAGCGACAGCCCTGTG | 16 | 4507 |
| 525747 | 36524 | 36540 | ACAAGCGACAGCCCTGT | 28 | 4508 |
| 525748 | 36652 | 36668 | AATGAGACAGGCAGCCC | 40 | 4509 |
| 525749 | 36653 | 36669 | GAATGAGACAGGCAGCC | 35 | 4510 |
| 525750 | 36654 | 36670 | AGAATGAGACAGGCAGC | 37 | 4511 |
| 525751 | 36679 | 36695 | CTCTGTGGGCTCCTCCA | 25 | 4512 |
| 525752 | 36680 | 36696 | GCTCTGTGGGCTCCTCC | 57 | 4513 |
| 525753 | 36681 | 36697 | TGCTCTGTGGGCTCCTC | 46 | 4514 |
| 525754 | 36682 | 36698 | GTGCTCTGTGGGCTCCT | 76 | 4515 |
| 525755 | 36683 | 36699 | TGTGCTCTGTGGGCTCC | 59 | 4516 |
| 525756 | 36686 | 36702 | CCCTGTGCTCTGTGGGC | 30 | 4517 |
| 525757 | 36687 | 36703 | GCCCTGTGCTCTGTGGG | 32 | 4518 |
| 525758 | 36688 | 36704 | GGCCCTGTGCTCTGTGG | 40 | 4519 |
| 525759 | 36738 | 36754 | CCACTGTCAGTCTCTCC | 40 | 4520 |
| 525760 | 36739 | 36755 | CCCACTGTCAGTCTCTC | 46 | 4521 |
| 525761 | 36740 | 36756 | CCCCACTGTCAGTCTCT | 29 | 4522 |
| 525762 | 36758 | 36774 | CTTGGCTGCAAGCTCTG | 22 | 4523 |
| 525763 | 36759 | 36775 | CCTTGGCTGCAAGCTCT | 37 | 4524 |
| 525764 | 36760 | 36776 | GCCTTGGCTGCAAGCTC | 30 | 4525 |

Example 5: Antisense Inhibition of Human DGAT2 in HepG2 Cells by MOE Gapmers

Antisense oligonucleotides were designed targeting a diacylglycerol acyltransferase 2 (DGAT2) nucleic acid and were tested for their effects on DGAT2 mRNA in vitro. The antisense oligonucleotides were tested in a series of experiments that had similar culture conditions. The results for each experiment are presented in separate tables shown below. Cultured HepG2 cells at a density of 20,000 cells per well were transfected using electroporation with 1,000 nM antisense oligonucleotide. After a treatment period of approximately 24 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. ISIS 413433, which consistently demonstrated higher potency than any of the previously disclosed oligonucleotides in the studies above was included in this study as a benchmark oligonucleotide. Antisense oligonucleotides that demonstrated about the same or greater potency than ISIS 413433 were therefore considered for further experimentation.

The newly designed chimeric antisense oligonucleotides in the Tables below were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines. "Start site" indicates the 5'-most nucleoside to which the gapmer is targeted in the human gene sequence. "Stop site" indicates the 3'-most nucleoside to which the gapmer is targeted human gene sequence. Each gapmer listed in the Tables below is targeted to the human DGAT2 genomic sequence, designated herein as SEQ ID NO: 2 (RefSeq No. NT_033927.5 truncated from nucleotides 5669186 to 5712008). 'n/a' indicates that the antisense oligonucleotide does not target that particular gene sequence with 100% complementarity. In case the sequence alignment for a target gene in a particular table is not shown, it is understood that none of the oligonucleotides presented in that table align with 100% complementarity with that target gene.

TABLE 64

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472445 | 1000 | 1019 | CTGCATTCTTGCCAGGCATG | 70 | 38153 | 38172 | 4527 |
| 472446 | 1001 | 1020 | ACTGCATTCTTGCCAGGCAT | 76 | 38154 | 38173 | 4528 |
| 472447 | 1003 | 1022 | TGACTGCATTCTTGCCAGGC | 82 | 38156 | 38175 | 4529 |
| 472448 | 1004 | 1023 | GTGACTGCATTCTTGCCAGG | 76 | 38157 | 38176 | 4530 |
| 472449 | 1006 | 1025 | GGGTGACTGCATTCTTGCCA | 42 | 38159 | 38178 | 4531 |
| 472450 | 1007 | 1026 | AGGGTGACTGCATTCTTGCC | 81 | 38160 | 38179 | 4532 |
| 472451 | 1008 | 1027 | CAGGGTGACTGCATTCTTGC | 71 | 38161 | 38180 | 4533 |
| 472452 | 1010 | 1029 | CGCAGGGTGACTGCATTCTT | 69 | 38163 | 38182 | 4534 |
| 472453 | 1011 | 1030 | CCGCAGGGTGACGCATTCT | 78 | 38164 | 38183 | 4535 |
| 472454 | 1013 | 1032 | TTCCGCAGGGTGACTGCATT | 53 | 38166 | 38185 | 4536 |
| 472455 | 1014 | 1033 | GTTCCGCAGGGTGACTGCAT | 76 | 38167 | 38186 | 4537 |
| 472456 | 1015 | 1034 | GGTTCCGCAGGGTGACTGCA | 86 | 38168 | 38187 | 4538 |
| 472457 | 1017 | 1036 | GCGGTTCCGCAGGGTGACTG | 77 | 38170 | 38189 | 4539 |
| 472458 | 1018 | 1037 | TGCGGTTCCGCAGGGTGACT | 81 | 38171 | 38190 | 4540 |
| 472459 | 1020 | 1039 | CTTGCGGTTCCGCAGGGTGA | 60 | 38173 | 38192 | 4541 |
| 472460 | 1021 | 1040 | CCTTGCGGTTCCGCAGGGTG | 55 | 38174 | 38193 | 4542 |
| 472461 | 1023 | 1042 | GCCCTTGCGGTTCCGCAGGG | 23 | 38176 | 38195 | 4543 |
| 472462 | 1024 | 1043 | AGCCCTTGCGGTTCCGCAGG | 61 | 38177 | 38196 | 4544 |
| 472463 | 1026 | 1045 | AAAGCCCTTGCGGTTCCGCA | 76 | 38179 | 38198 | 4545 |
| 472464 | 1027 | 1046 | CAAAGCCCTTGCGGTTCCGC | 74 | 38180 | 38199 | 4546 |

TABLE 64-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472465 | 1029 | 1048 | CACAAAGCCCTTGCGGTTCC | 53 | 38182 | 38201 | 4547 |
| 472466 | 1030 | 1049 | TCACAAAGCCCTTGCGGTTC | 23 | 38183 | 38202 | 4548 |
| 472467 | 1032 | 1051 | TTTCACAAAGCCCTTGCGGT | 0 | 38185 | 38204 | 4549 |
| 472468 | 1033 | 1052 | GTTTCACAAAGCCCTTGCGG | 46 | 38186 | 38205 | 4550 |
| 472469 | 1035 | 1054 | CAGTTTCACAAAGCCCTTGC | 51 | 38188 | 38207 | 4551 |
| 472470 | 1036 | 1055 | CCAGTTTCACAAAGCCCTTG | 55 | 38189 | 38208 | 4552 |
| 472471 | 1038 | 1057 | GGCCAGTTTCACAAAGCCCT | 37 | 38191 | 38210 | 4553 |
| 472472 | 1039 | 1058 | GGGCCAGTTTCACAAAGCCC | 0 | 38192 | 38211 | 4554 |
| 472473 | 1041 | 1060 | CAGGGCCAGTTTCACAAAGC | 34 | 38194 | 38213 | 4555 |
| 472474 | 1042 | 1061 | GCAGGGCCAGTTTCACAAAG | 63 | 38195 | 38214 | 4556 |
| 472475 | 1089 | 1108 | TTCATTCTCTCCAAAGGAGT | 66 | 39136 | 39155 | 4557 |
| 472476 | 1090 | 1109 | CTTCATTCTCTCCAAAGGAG | 75 | 39137 | 39156 | 4558 |
| 472477 | 1092 | 1111 | CACTTCATTCTCTCCAAAGG | 78 | 39139 | 39158 | 4559 |
| 472478 | 1093 | 1112 | ACACTTCATTCTCTCCAAAG | 84 | 39140 | 39159 | 4560 |
| 472479 | 1094 | 1113 | TACACTTCATTCTCTCCAAA | 62 | 39141 | 39160 | 4561 |
| 472480 | 1096 | 1115 | TGTACACTTCATTCTCTCCA | 95 | 39143 | 39162 | 4562 |
| 472481 | 1097 | 1116 | TTGTACACTTCATTCTCTCC | 89 | 39144 | 39163 | 4563 |
| 472482 | 1099 | 1118 | GCTTGTACACTTCATTCTCT | 91 | 39146 | 39165 | 4564 |
| 472483 | 1100 | 1119 | TGCTTGTACACTTCATTCTC | 75 | 39147 | 39166 | 4565 |
| 472484 | 1102 | 1121 | CCTGCTTGTACACTTCATTC | 90 | 39149 | 39168 | 4566 |
| 472485 | 1103 | 1122 | ACCTGCTTGTACACTTCATT | 86 | 39150 | 39169 | 4567 |
| 472486 | 1104 | 1123 | CACCTGCTTGTACACTTCAT | 95 | 39151 | 39170 | 4568 |
| 472487 | 1106 | 1125 | ATCACCTGCTTGTACACTTC | 90 | 39153 | 39172 | 4569 |
| 472488 | 1107 | 1126 | GATCACCTGCTTGTACACTT | 86 | 39154 | 39173 | 4570 |
| 472489 | 1109 | 1128 | AAGATCACCTGCTTGTACAC | 69 | 39156 | 39175 | 4571 |
| 472490 | 1110 | 1129 | GAAGATCACCTGCTTGTACA | 63 | 39157 | 39176 | 4572 |
| 472491 | 1112 | 1131 | TCGAAGATCACCTGCTTGTA | 72 | 39159 | 39178 | 4573 |
| 472492 | 1113 | 1132 | CTCGAAGATCACCTGCTTGT | 51 | 39160 | 39179 | 4574 |
| 472493 | 1115 | 1134 | TCCTCGAAGATCACCTGCTT | 71 | 39162 | 39181 | 4575 |
| 472494 | 1116 | 1135 | CTCCTCGAAGATCACCTGCT | 70 | 39163 | 39182 | 4576 |
| 472495 | 1118 | 1137 | CCCTCCTCGAAGATCACCTG | 69 | 39165 | 39184 | 4577 |
| 472496 | 1119 | 1138 | GCCCTCCTCGAAGATCACCT | 87 | 39166 | 39185 | 4578 |
| 472497 | 1121 | 1140 | GAGCCCTCCTCGAAGATCAC | 54 | 39168 | 39187 | 4579 |
| 472498 | 1122 | 1141 | GGAGCCCTCCTCGAAGATCA | 77 | 39169 | 39188 | 4580 |
| 472499 | 1124 | 1143 | CAGGAGCCCTCCTCGAAGAT | 65 | 39171 | 39190 | 4581 |

TABLE 64-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472500 | 1125 | 1144 | CCAGGAGCCCTCCTCGAAGA | 72 | 39172 | 39191 | 4582 |
| 472501 | 1127 | 1146 | CCCCAGGAGCCCTCCTCGAA | 60 | 39174 | 39193 | 4583 |
| 472502 | 1128 | 1147 | GCCCCAGGAGCCCTCCTCGA | 48 | 39175 | 39194 | 4584 |
| 472503 | 1130 | 1149 | CGGCCCCAGGAGCCCTCCTC | 21 | 39177 | 39196 | 4585 |
| 472504 | 1131 | 1150 | TCGGCCCCAGGAGCCCTCCT | 26 | 39178 | 39197 | 4586 |
| 472505 | 1132 | 1151 | ATCGGCCCCAGGAGCCCTCC | 1 | 39179 | 39198 | 4587 |
| 472506 | 1134 | 1153 | CCATCGGCCCCAGGAGCCCT | 70 | 39181 | 39200 | 4588 |
| 472507 | 1135 | 1154 | CCCATCGGCCCCAGGAGCCC | 74 | 39182 | 39201 | 4589 |
| 472508 | 1137 | 1156 | GACCCATCGGCCCCAGGAGC | 44 | 39184 | 39203 | 4590 |
| 472509 | 1138 | 1157 | GGACCCATCGGCCCCAGGAG | 45 | 39185 | 39204 | 4591 |
| 472510 | 1158 | 1177 | GTATTTCTGGAACTTCTTCT | 71 | 39205 | 39224 | 4592 |
| 472511 | 1159 | 1178 | TGTATTTCTGGAACTTCTTC | 63 | 39206 | 39225 | 4593 |
| 472512 | 1161 | 1180 | AATGTATTTCTGGAACTTCT | 60 | 39208 | 39227 | 4594 |
| 472513 | 1162 | 1181 | CAATGTATTTCTGGAACTTC | 36 | 39209 | 39228 | 4595 |
| 472514 | 1164 | 1183 | ACCAATGTATTTCTGGAACT | 72 | 39211 | 39230 | 4596 |
| 472515 | 1165 | 1184 | AACCAATGTATTTCTGGAAC | 68 | 39212 | 39231 | 4597 |
| 472516 | 1166 | 1185 | AAACCAATGTATTTCTGGAA | 50 | 39213 | 39232 | 4598 |
| 472517 | 1167 | 1186 | GAAACCAATGTATTTCTGGA | 65 | 39214 | 39233 | 4599 |
| 472518 | 1169 | 1188 | GCGAAACCAATGTATTTCTG | 76 | 39216 | 39235 | 4600 |
| 472519 | 1170 | 1189 | GGCGAAACCAATGTATTTCT | 75 | 39217 | 39236 | 4601 |
| 472520 | 1209 | 1228 | GTCGGAGGAGAAGAGGCCTC | 43 | 39256 | 39275 | 4602 |
| 472444 | 998 | 1017 | GCATTCTTGCCAGGCATGGA | 89 | 38151 | 38170 | 4526 |
| 413433 | n/a | n/a | GCCTGGACAAGTCCTGCCCA | 87 | 32431 | 32450 | 425 |

TABLE 65

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472588 | 1558 | 1577 | TTCTTAAAAAAGACCTAACA | 22 | 41529 | 41548 | 4603 |
| 472589 | 1560 | 1579 | CCTTCTTAAAAAAGACCTAA | 70 | 41531 | 41550 | 4604 |
| 472590 | 1561 | 1580 | TCCTTCTTAAAAAAGACCTA | 65 | 41532 | 41551 | 4605 |
| 472591 | 1562 | 1581 | TTCCTTCTTAAAAAAGACCT | 58 | 41533 | 41552 | 4606 |
| 472592 | 1564 | 1583 | TTTTCCTTCTTAAAAAAGAC | 14 | 41535 | 41554 | 4607 |
| 472593 | 1565 | 1584 | TTTTTCCTTCTTAAAAAAGA | 9 | 41536 | 41555 | 4608 |

TABLE 65-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472594 | 1566 | 1585 | CTTTTTCCTTCTTAAAAAG | 15 | 41537 | 41556 | 4609 |
| 472595 | 1568 | 1587 | GACTTTTTCCTTCTTAAAAA | 36 | 41539 | 41558 | 4610 |
| 472596 | 1569 | 1588 | TGACTTTTTCCTTCTTAAAA | 36 | 41540 | 41559 | 4611 |
| 472597 | 1570 | 1589 | CTGACTTTTTCCTTCTTAAA | 75 | 41541 | 41560 | 4612 |
| 472598 | 1571 | 1590 | ACTGACTTTTTCCTTCTTAA | 77 | 41542 | 41561 | 4613 |
| 472599 | 1615 | 1634 | CACCACCTAGAACAGGGCAA | 70 | 41586 | 41605 | 4614 |
| 472600 | 1617 | 1636 | GCCACCACCTAGAACAGGGC | 44 | 41588 | 41607 | 4615 |
| 472601 | 1618 | 1637 | AGCCACCACCTAGAACAGGG | 70 | 41589 | 41608 | 4616 |
| 472602 | 1619 | 1638 | TAGCCACCACCTAGAACAGG | 46 | 41590 | 41609 | 4617 |
| 472603 | 1621 | 1640 | TTTAGCCACCACCTAGAACA | 51 | 41592 | 41611 | 4618 |
| 472604 | 1622 | 1641 | ATTTAGCCACCACCTAGAAC | 40 | 41593 | 41612 | 4619 |
| 472605 | 1623 | 1642 | GATTTAGCCACCACCTAGAA | 63 | 41594 | 41613 | 4620 |
| 472606 | 1624 | 1643 | AGATTTAGCCACCACCTAGA | 54 | 41595 | 41614 | 4621 |
| 472607 | 1626 | 1645 | CCAGATTTAGCCACCACCTA | 74 | 41597 | 41616 | 4622 |
| 472608 | 1627 | 1646 | CCCAGATTTAGCCACCACCT | 88 | 41598 | 41617 | 4623 |
| 472609 | 1628 | 1647 | GCCCAGATTTAGCCACCACC | 78 | 41599 | 41618 | 4624 |
| 472610 | 1629 | 1648 | GGCCCAGATTTAGCCACCAC | 83 | 41600 | 41619 | 4625 |
| 472611 | 1631 | 1650 | TAGGCCCAGATTTAGCCACC | 51 | 41602 | 41621 | 4626 |
| 472612 | 1632 | 1651 | TTAGGCCCAGATTTAGCCAC | 14 | 41603 | 41622 | 4627 |
| 472613 | 1633 | 1652 | ATTAGGCCCAGATTTAGCCA | 45 | 41604 | 41623 | 4628 |
| 472614 | 1634 | 1653 | GATTAGGCCCAGATTTAGCC | 44 | 41605 | 41624 | 4629 |
| 472615 | 1636 | 1655 | CAGATTAGGCCCAGATTTAG | 16 | 41607 | 41626 | 4630 |
| 472616 | 1637 | 1656 | CCAGATTAGGCCCAGATTTA | 40 | 41608 | 41627 | 4631 |
| 472617 | 1638 | 1657 | CCCAGATTAGGCCCAGATTT | 40 | 41609 | 41628 | 4632 |
| 472618 | 1639 | 1658 | ACCCAGATTAGGCCCAGATT | 50 | 41610 | 41629 | 4633 |
| 472619 | 1641 | 1660 | CCACCCAGATTAGGCCCAGA | 71 | 41612 | 41631 | 4634 |
| 472620 | 1642 | 1661 | GCCACCCAGATTAGGCCCAG | 73 | 41613 | 41632 | 4635 |
| 472621 | 1643 | 1662 | AGCCACCCAGATTAGGCCCA | 65 | 41614 | 41633 | 4636 |
| 472622 | 1644 | 1663 | GAGCCACCCAGATTAGGCCC | 26 | 41615 | 41634 | 4637 |
| 472623 | 1646 | 1665 | CTGAGCCACCCAGATTAGGC | 23 | 41617 | 41636 | 4638 |
| 472624 | 1647 | 1666 | GCTGAGCCACCCAGATTAGG | 24 | 41618 | 41637 | 4639 |
| 472625 | 1648 | 1667 | AGCTGAGCCACCCAGATTAG | 2 | 41619 | 41638 | 4640 |
| 472626 | 1649 | 1668 | TAGCTGAGCCACCCAGATTA | 31 | 41620 | 41639 | 4641 |
| 472627 | 1651 | 1670 | GTTAGCTGAGCCACCCAGAT | 48 | 41622 | 41641 | 4642 |
| 472628 | 1652 | 1671 | GGTTAGCTGAGCCACCCAGA | 57 | 41623 | 41642 | 4643 |

TABLE 65-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472629 | 1654 | 1673 | GAGGTTAGCTGAGCCACCCA | 66 | 41625 | 41644 | 4644 |
| 472630 | 1655 | 1674 | AGAGGTTAGCTGAGCCACCC | 51 | 41626 | 41645 | 4645 |
| 472631 | 1677 | 1696 | GTCACTTCAGGAAGGGAAGA | 54 | 41648 | 41667 | 4646 |
| 472632 | 1678 | 1697 | TGTCACTTCAGGAAGGGAAG | 58 | 41649 | 41668 | 4647 |
| 472633 | 1749 | 1768 | AAAAGTGAATCATCTAACTG | 23 | 41720 | 41739 | 4648 |
| 472634 | 1750 | 1769 | AAAAAGTGAATCATCTAACT | 0 | 41721 | 41740 | 4649 |
| 472635 | 1751 | 1770 | CAAAAAGTGAATCATCTAAC | 2 | 41722 | 41741 | 4650 |
| 472636 | 1752 | 1771 | GCAAAAAGTGAATCATCTAA | 55 | 41723 | 41742 | 4651 |
| 472637 | 1754 | 1773 | GGGCAAAAAGTGAATCATCT | 79 | 41725 | 41744 | 4652 |
| 472638 | 1790 | 1809 | CTTGTATGAGAAGTGGCTTT | 58 | 41761 | 41780 | 4653 |
| 472639 | 1791 | 1810 | GCTTGTATGAGAAGTGGCTT | 49 | 41762 | 41781 | 4654 |
| 472640 | 1793 | 1812 | GGGCTTGTATGAGAAGTGGC | 67 | 41764 | 41783 | 4655 |
| 472641 | 1838 | 1857 | CCTGCAGTTTCAGGACTAGA | 64 | 41809 | 41828 | 4656 |
| 472642 | 1839 | 1858 | TCCTGCAGTTTCAGGACTAG | 50 | 41810 | 41829 | 4657 |
| 472643 | 1841 | 1860 | GGTCCTGCAGTTTCAGGACT | 11 | 41812 | 41831 | 4658 |
| 472644 | 1842 | 1861 | TGGTCCTGCAGTTTCAGGAC | 20 | 41813 | 41832 | 4659 |
| 472645 | 1843 | 1862 | CTGGTCCTGCAGTTTCAGGA | 41 | 41814 | 41833 | 4660 |
| 472646 | 1845 | 1864 | AACTGGTCCTGCAGTTTCAG | 50 | 41816 | 41835 | 4661 |
| 472647 | 1846 | 1865 | AAACTGGTCCTGCAGTTTCA | 56 | 41817 | 41836 | 4662 |
| 472648 | 1848 | 1867 | AGAAACTGGTCCTGCAGTTT | 40 | 41819 | 41838 | 4663 |
| 472649 | 1849 | 1868 | GAGAAACTGGTCCTGCAGTT | 24 | 41820 | 41839 | 4664 |
| 472650 | 1850 | 1869 | AGAGAAACTGGTCCTGCAGT | 29 | 41821 | 41840 | 4665 |
| 472651 | 1851 | 1870 | CAGAGAAACTGGTCCTGCAG | 35 | 41822 | 41841 | 4666 |
| 472652 | 1853 | 1872 | GGCAGAGAAACTGGTCCTGC | 84 | 41824 | 41843 | 4667 |
| 472653 | 1854 | 1873 | TGGCAGAGAAACTGGTCCTG | 71 | 41825 | 41844 | 4668 |
| 472654 | 1855 | 1874 | TTGGCAGAGAAACTGGTCCT | 63 | 41826 | 41845 | 4669 |
| 472655 | 1856 | 1875 | CTTGGCAGAGAAACTGGTCC | 62 | 41827 | 41846 | 4670 |
| 472656 | 1858 | 1877 | CCCTTGGCAGAGAAACTGGT | 49 | 41829 | 41848 | 4671 |
| 472657 | 1859 | 1878 | CCCCTTGGCAGAGAAACTGG | 66 | 41830 | 41849 | 4672 |
| 472658 | 1861 | 1880 | CTCCCCTTGGCAGAGAAACT | 58 | 41832 | 41851 | 4673 |
| 472659 | 1862 | 1881 | CCTCCCCTTGGCAGAGAAAC | 54 | 41833 | 41852 | 4674 |
| 472660 | 1863 | 1882 | TCCTCCCCTTGGCAGAGAAA | 49 | 41834 | 41853 | 4675 |
| 472661 | 1865 | 1884 | ACTCCTCCCCTTGGCAGAGA | 47 | 41836 | 41855 | 4676 |
| 472662 | 1866 | 1885 | AACTCCTCCCCTTGGCAGAG | 39 | 41837 | 41856 | 4677 |
| 472663 | 1867 | 1886 | CAACTCCTCCCCTTGGCAGA | 0 | 41838 | 41857 | 4678 |

TABLE 65-continued

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472664 | 1869 | 1888 | TCCAACTCCTCCCCTTGGCA | 29 | 41840 | 41859 | 4679 |
| 413433 | n/a | n/a | GCCTGGACAAGTCCTGCCCA | 85 | 32431 | 32450 | 425 |

TABLE 66

Inhibition of DGAT2 mRNA by 5-10-5 MOE
gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472445 | 1000 | 1019 | CTGCATTCTTGCCAGGCATG | 53 | 38153 | 38172 | 4527 |
| 472446 | 1001 | 1020 | ACTGCATTCTTGCCAGGCAT | 60 | 38154 | 38173 | 4528 |
| 472447 | 1003 | 1022 | TGACTGCATTCTTGCCAGGC | 52 | 38156 | 38175 | 4529 |
| 472448 | 1004 | 1023 | GTGACTGCATTCTTGCCAGG | 60 | 38157 | 38176 | 4530 |
| 472449 | 1006 | 1025 | GGGTGACTGCATTCTTGCCA | 0 | 38159 | 38178 | 4531 |
| 472450 | 1007 | 1026 | AGGGTGACTGCATTCTTGCC | 62 | 38160 | 38179 | 4532 |
| 472451 | 1008 | 1027 | CAGGGTGACTGCATTCTTGC | 43 | 38161 | 38180 | 4533 |
| 472452 | 1010 | 1029 | CGCAGGGTGACTGCATTCTT | 25 | 38163 | 38182 | 4534 |
| 472453 | 1011 | 1030 | CCGCAGGGTGACTGCATTCT | 45 | 38164 | 38183 | 4535 |
| 472454 | 1013 | 1032 | TTCCGCAGGGTGACTGCATT | 16 | 38166 | 38185 | 4536 |
| 472455 | 1014 | 1033 | GTTCCGCAGGGTGACTGCAT | 29 | 38167 | 38186 | 4537 |
| 472456 | 1015 | 1034 | GGTTCCGCAGGGTGACTGCA | 62 | 38168 | 38187 | 4538 |
| 472457 | 1017 | 1036 | GCGGTTCCGCAGGGTGACTG | 33 | 38170 | 38189 | 4539 |
| 472458 | 1018 | 1037 | TGCGGTTCCGCAGGGTGACT | 57 | 38171 | 38190 | 4540 |
| 472459 | 1020 | 1039 | CTTGCGGTTCCGCAGGGTGA | 39 | 38173 | 38192 | 4541 |
| 472460 | 1021 | 1040 | CCTTGCGGTTCCGCAGGGTG | 25 | 38174 | 38193 | 4542 |
| 472461 | 1023 | 1042 | GCCCTTGCGGTTCCGCAGGG | 9 | 38176 | 38195 | 4543 |
| 472462 | 1024 | 1043 | AGCCCTTGCGGTTCCGCAGG | 32 | 38177 | 38196 | 4544 |
| 472463 | 1026 | 1045 | AAAGCCCTTGCGGTTCCGCA | 46 | 38179 | 38198 | 4545 |
| 472464 | 1027 | 1046 | CAAAGCCCTTGCGGTTCCGC | 48 | 38180 | 38199 | 4546 |
| 472465 | 1029 | 1048 | CACAAAGCCCTTGCGGTTCC | 8 | 38182 | 38201 | 4547 |
| 472466 | 1030 | 1049 | TCACAAAGCCCTTGCGGTTC | 0 | 38183 | 38202 | 4548 |
| 472467 | 1032 | 1051 | TTTCACAAAGCCCTTGCGGT | 0 | 38185 | 38204 | 4549 |
| 472468 | 1033 | 1052 | GTTTCACAAAGCCCTTGCGG | 18 | 38186 | 38205 | 4550 |
| 472469 | 1035 | 1054 | CAGTTTCACAAAGCCCTTGC | 0 | 38188 | 38207 | 4551 |
| 472470 | 1036 | 1055 | CCAGTTTCACAAAGCCCTTG | 23 | 38189 | 38208 | 4552 |

TABLE 66-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472471 | 1038 | 1057 | GGCCAGTTTCACAAAGCCCT | 2 | 38191 | 38210 | 4553 |
| 472472 | 1039 | 1058 | GGGCCAGTTTCACAAAGCCC | 0 | 38192 | 38211 | 4554 |
| 472473 | 1041 | 1060 | CAGGGCCAGTTTCACAAAGC | 0 | 38194 | 38213 | 4555 |
| 472474 | 1042 | 1061 | GCAGGGCCAGTTTCACAAAG | 10 | 38195 | 38214 | 4556 |
| 472475 | 1089 | 1108 | TTCATTCTCTCCAAAGGAGT | 47 | 39136 | 39155 | 4557 |
| 472476 | 1090 | 1109 | CTTCATTCTCTCCAAAGGAG | 65 | 39137 | 39156 | 4558 |
| 472477 | 1092 | 1111 | CACTTCATTCTCTCCAAAGG | 51 | 39139 | 39158 | 4559 |
| 472478 | 1093 | 1112 | ACACTTCATTCTCTCCAAAG | 68 | 39140 | 39159 | 4560 |
| 472479 | 1094 | 1113 | TACACTTCATTCTCTCCAAA | 41 | 39141 | 39160 | 4561 |
| 472480 | 1096 | 1115 | TGTACACTTCATTCTCTCCA | 85 | 39143 | 39162 | 4562 |
| 472481 | 1097 | 1116 | TTGTACACTTCATTCTCTCC | 72 | 39144 | 39163 | 4563 |
| 472482 | 1099 | 1118 | GCTTGTACACTTCATTCTCT | 80 | 39146 | 39165 | 4564 |
| 472483 | 1100 | 1119 | TGCTTGTACACTTCATTCTC | 64 | 39147 | 39166 | 4565 |
| 472484 | 1102 | 1121 | CCTGCTTGTACACTTCATTC | 75 | 39149 | 39168 | 4566 |
| 472485 | 1103 | 1122 | ACCTGCTTGTACACTTCATT | 67 | 39150 | 39169 | 4567 |
| 472486 | 1104 | 1123 | CACCTGCTTGTACACTTCAT | 88 | 39151 | 39170 | 4568 |
| 472487 | 1106 | 1125 | ATCACCTGCTTGTACACTTC | 59 | 39153 | 39172 | 4569 |
| 472488 | 1107 | 1126 | GATCACCTGCTTGTACACTT | 70 | 39154 | 39173 | 4570 |
| 472489 | 1109 | 1128 | AAGATCACCTGCTTGTACAC | 28 | 39156 | 39175 | 4571 |
| 472490 | 1110 | 1129 | GAAGATCACCTGCTTGTACA | 53 | 39157 | 39176 | 4572 |
| 472491 | 1112 | 1131 | TCGAAGATCACCTGCTTGTA | 52 | 39159 | 39178 | 4573 |
| 472492 | 1113 | 1132 | CTCGAAGATCACCTGCTTGT | 49 | 39160 | 39179 | 4574 |
| 472493 | 1115 | 1134 | TCCTCGAAGATCACCTGCTT | 46 | 39162 | 39181 | 4575 |
| 472494 | 1116 | 1135 | CTCCTCGAAGATCACCTGCT | 55 | 39163 | 39182 | 4576 |
| 472495 | 1118 | 1137 | CCCTCCTCGAAGATCACCTG | 54 | 39165 | 39184 | 4577 |
| 472496 | 1119 | 1138 | GCCCTCCTCGAAGATCACCT | 74 | 39166 | 39185 | 4578 |
| 472497 | 1121 | 1140 | GAGCCCTCCTCGAAGATCAC | 54 | 39168 | 39187 | 4579 |
| 472498 | 1122 | 1141 | GGAGCCCTCCTCGAAGATCA | 68 | 39169 | 39188 | 4580 |
| 472499 | 1124 | 1143 | CAGGAGCCCTCCTCGAAGAT | 37 | 39171 | 39190 | 4581 |
| 472500 | 1125 | 1144 | CCAGGAGCCCTCCTCGAAGA | 41 | 39172 | 39191 | 4582 |
| 472501 | 1127 | 1146 | CCCCAGGAGCCCTCCTCGAA | 34 | 39174 | 39193 | 4583 |
| 472502 | 1128 | 1147 | GCCCCAGGAGCCCTCCTCGA | 17 | 39175 | 39194 | 4584 |
| 472503 | 1130 | 1149 | CGGCCCCAGGAGCCCTCCTC | 0 | 39177 | 39196 | 4585 |
| 472504 | 1131 | 1150 | TCGGCCCCAGGAGCCCTCCT | 16 | 39178 | 39197 | 4586 |
| 472505 | 1132 | 1151 | ATCGGCCCCAGGAGCCCTCC | 0 | 39179 | 39198 | 4587 |
| 472506 | 1134 | 1153 | CCATCGGCCCCAGGAGCCCT | 64 | 39181 | 39200 | 4588 |

TABLE 66-continued

Inhibition of DGAT2 mRNA by 5-10-5 MOE gapmers targeting SEQ ID NO: 1 and 2

| ISIS NO | SEQ ID NO: 1 Start Site | SEQ ID NO: 1 Stop Site | Sequence | % inhibition | SEQ ID NO: 2 Start Site | SEQ ID NO: 2 Stop Site | SEQ ID NO |
|---|---|---|---|---|---|---|---|
| 472507 | 1135 | 1154 | CCCATCGGCCCCAGGAGCCC | 55 | 39182 | 39201 | 4589 |
| 472508 | 1137 | 1156 | GACCCATCGGCCCCAGGAGC | 34 | 39184 | 39203 | 4590 |
| 472509 | 1138 | 1157 | GGACCCATCGGCCCCAGGAG | 50 | 39185 | 39204 | 4591 |
| 472510 | 1158 | 1177 | GTATTTCTGGAACTTCTTCT | 64 | 39205 | 39224 | 4592 |
| 472511 | 1159 | 1178 | TGTATTTCTGGAACTTCTTC | 49 | 39206 | 39225 | 4593 |
| 472512 | 1161 | 1180 | AATGTATTTCTGGAACTTCT | 40 | 39208 | 39227 | 4594 |
| 472513 | 1162 | 1181 | CAATGTATTTCTGGAACTTC | 4 | 39209 | 39228 | 4595 |
| 472514 | 1164 | 1183 | ACCAATGTATTTCTGGAACT | 41 | 39211 | 39230 | 4596 |
| 472515 | 1165 | 1184 | AACCAATGTATTTCTGGAAC | 41 | 39212 | 39231 | 4597 |
| 472516 | 1166 | 1185 | AAACCAATGTATTTCTGGAA | 34 | 39213 | 39232 | 4598 |
| 472517 | 1167 | 1186 | GAAACCAATGTATTTCTGGA | 51 | 39214 | 39233 | 4599 |
| 472518 | 1169 | 1188 | GCGAAACCAATGTATTTCTG | 54 | 39216 | 39235 | 4600 |
| 472519 | 1170 | 1189 | GGCGAAACCAATGTATTTCT | 59 | 39217 | 39236 | 4601 |
| 472520 | 1209 | 1228 | GTCGGAGGAGAAGAGGCCTC | 17 | 39256 | 39275 | 4602 |
| 472444 | 998 | 1017 | GCATTCTTGCCAGGCATGGA | 77 | 38151 | 38170 | 4526 |
| 413433 | n/a | n/a | GCCTGGACAAGTCCTGCCCA | 76 | 32431 | 32450 | 425 |

Example 6: Dose-Dependent Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. The antisense oligonucleotides were tested in a series of experiments that had similar culture conditions. Previously disclosed oligonucleotides, ISIS 21316, ISIS 217317, ISIS 217328, ISIS 369185, ISIS 366714, ISIS 366730, ISIS 366746, and ISIS 369241 from earlier published application, WO 2005/019418, were included in the assay. The results for each experiment are presented in separate tables shown below. Cells were plated at a density of 10,000 cells per well and transfected using Lipofectin reagent with 6.25 nM, 12.5 nM, 25.0 nM, 50 nM, 100 nM, or 200.0 nM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2367 was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited. 'n.d.' indicates that the inhibition levels were not recorded.

The half maximal inhibitory concentration ($IC_{50}$) of each oligonucleotide is also presented. DGAT2 mRNA levels were significantly reduced in a dose-dependent manner in antisense oligonucleotide treated cells. The results also demonstrate that several newly designed oligonucleotides had greater efficacy than the previously disclosed oligonucleotides.

TABLE 67

| ISIS No | 6.25 nM | 12.5 nM | 25.0 nM | 50.0 nM | 100.0 nM | 200.0 nM | $IC_{50}$ (nM) |
|---|---|---|---|---|---|---|---|
| 217316 | 7 | 7 | 27 | 47 | 68 | 63 | 55 |
| 217317 | 3 | 12 | 32 | 50 | 75 | 84 | 44 |
| 369185 | 17 | 12 | 34 | 63 | 78 | 81 | 42 |
| 381726 | 4 | 30 | 44 | 56 | 76 | 83 | 37 |
| 411874 | 15 | 31 | 27 | 54 | 66 | 66 | 40 |
| 411899 | 5 | 22 | 31 | 57 | 74 | 87 | 39 |
| 411901 | 0 | 6 | 24 | 46 | 66 | 65 | 58 |
| 411905 | 6 | 30 | 29 | 58 | 73 | 76 | 34 |
| 411912 | 8 | 24 | 31 | 56 | 79 | 89 | 35 |
| 411941 | 11 | 22 | 30 | 59 | 77 | 82 | 35 |

TABLE 68

| ISIS No | 6.25 nM | 12.5 nM | 25.0 nM | 50.0 nM | 100.0 nM | 200.0 nM | $IC_{50}$ (nM) |
|---|---|---|---|---|---|---|---|
| 366714 | 7 | 8 | 42 | 67 | 79 | 82 | 33 |
| 366730 | 0 | 18 | 33 | 72 | 84 | 91 | 43 |
| 411944 | 2 | 14 | 46 | 65 | 82 | 93 | 30 |
| 411945 | 14 | 21 | 51 | 68 | 86 | n.d. | 24 |
| 411950 | 6 | 5 | 28 | 66 | 84 | n.d. | 29 |

TABLE 68-continued

| ISIS No | 6.25 nM | 12.5 nM | 25.0 nM | 50.0 nM | 100.0 nM | 200.0 nM | IC$_{50}$ (nM) |
|---|---|---|---|---|---|---|---|
| 413176 | 7 | 16 | 24 | 58 | 78 | 88 | 38 |
| 413192 | 0 | 6 | 30 | 62 | 80 | 80 | 57 |
| 413200 | 2 | 18 | 20 | 60 | 78 | 77 | 36 |
| 413213 | 9 | 12 | 34 | 55 | 84 | 90 | 45 |
| 413226 | 3 | 22 | 13 | 36 | 72 | 87 | 41 |

TABLE 69

| ISIS No | 6.25 nM | 12.5 nM | 25.0 nM | 50.0 nM | 100.0 nM | 200.0 nM | IC$_{50}$ (nM) |
|---|---|---|---|---|---|---|---|
| 366746 | 5 | 7 | 21 | 32 | 62 | 77 | 66 |
| 369241 | 0 | 4 | 10 | 35 | 56 | 63 | 106 |
| 413198 | 10 | 16 | 24 | 53 | 72 | 73 | 51 |
| 413214 | 1 | 17 | 43 | 61 | 81 | 77 | 34 |
| 413232 | 8 | 23 | 33 | 60 | 78 | 82 | 35 |
| 413236 | 0 | 12 | 3 | 52 | 71 | 72 | 47 |
| 413253 | 6 | 7 | 27 | 59 | 72 | 75 | 64 |
| 413258 | 0 | 12 | 27 | 46 | 78 | 77 | 62 |
| 413266 | 0 | 0 | 21 | 48 | 76 | 75 | 52 |
| 413284 | 4 | 0 | 22 | 45 | 57 | 65 | 78 |

TABLE 70

| ISIS No | 6.25 nM | 12.5 nM | 25.0 nM | 50.0 nM | 100.0 nM | 200.0 nM | IC$_{50}$ (nM) |
|---|---|---|---|---|---|---|---|
| 217328 | 4 | 15 | 31 | 50 | 64 | 72 | 62 |
| 413243 | 0 | 10 | 28 | 50 | 69 | 77 | 66 |
| 413351 | 4 | 16 | 16 | 39 | 56 | 69 | 51 |
| 413356 | 16 | 12 | 23 | 51 | 63 | 69 | 34 |
| 413364 | 0 | 0 | 21 | 41 | 58 | 53 | 52 |
| 413399 | 0 | 3 | 23 | 35 | 60 | 58 | 78 |
| 413413 | 1 | 0 | 30 | 50 | 71 | 77 | 64 |
| 413422 | 0 | 0 | 8 | 41 | 63 | 70 | 62 |
| 413433 | 5 | 5 | 20 | 55 | 77 | 82 | 47 |
| 413441 | 2 | 5 | 26 | 50 | 70 | 79 | 106 |
| 413446 | 0 | 0 | 10 | 41 | 63 | 78 | 35 |

TABLE 71

| ISIS No | 6.25 nM | 12.5 nM | 25.0 nM | 50.0 nM | 100.0 nM | 200.0 nM | IC$_{50}$ (nM) |
|---|---|---|---|---|---|---|---|
| 217317 | 0 | 0 | 11 | 34 | 64 | 84 | 77 |
| 366730 | 0 | 15 | 33 | 61 | 87 | 91 | 45 |
| 381726 | 1 | 11 | 31 | 51 | 71 | 83 | 48 |
| 411899 | 6 | 0 | 25 | 39 | 70 | 89 | 55 |
| 411912 | 0 | 0 | 13 | 58 | 77 | 87 | 40 |
| 411944 | 7 | 21 | 32 | 67 | 76 | 87 | 42 |
| 413176 | 0 | 12 | 20 | 54 | 89 | 88 | 46 |
| 413232 | 16 | 10 | 30 | 60 | 79 | 90 | 31 |
| 413433 | 15 | 17 | 37 | 71 | 84 | 87 | 24 |
| 413446 | 0 | 0 | 44 | 73 | 77 | 86 | 47 |

Example 7: Dose-Dependent Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. The antisense oligonucleotides were tested in a series of experiments that had similar culture conditions. Previously disclosed oligonucleotides from earlier published application, WO 2005/019418, were included in the assay. The results for each experiment are presented in separate tables shown below.

Study 1

Cells were plated at a density of 10,000 cells per well and transfected using Lipofectin reagent with 18.75 nM, 37.5 nM, 75.0 nM, or 150.0 nM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 72

| ISIS No | Motif | 18.75 nM | 37.5 nM | 75.0 nM | 150.0 nM | IC$_{50}$ (nM) |
|---|---|---|---|---|---|---|
| 217328 | 5-10-5 | 27 | 44 | 62 | 73 | 47 |
| 366730 | 5-10-5 | 27 | 36 | 61 | 77 | 48 |
| 411944 | 5-10-5 | 19 | 38 | 48 | 69 | 67 |
| 411945 | 5-10-5 | 14 | 26 | 45 | 61 | 93 |
| 413253 | 5-10-5 | 24 | 34 | 50 | 68 | 73 |
| 413433 | 5-10-5 | 28 | 39 | 56 | 68 | 58 |
| 423440 | 5-10-5 | 18 | 39 | 53 | 70 | 67 |
| 423441 | 5-10-5 | 23 | 36 | 54 | 66 | 63 |
| 423444 | 5-10-5 | 15 | 32 | 53 | 69 | 71 |
| 423447 | 5-10-5 | 24 | 36 | 55 | 71 | 60 |
| 423463 | 5-10-5 | 23 | 39 | 59 | 73 | 56 |
| 423489 | 3-14-3 | 21 | 32 | 55 | 73 | 60 |
| 423490 | 3-14-3 | 27 | 32 | 51 | 60 | 76 |
| 423498 | 3-14-3 | 19 | 38 | 56 | 77 | 59 |
| 423499 | 5-10-5 | 23 | 37 | 59 | 77 | 53 |
| 423523 | 3-14-3 | 25 | 41 | 60 | 73 | 56 |
| 423524 | 3-14-3 | 24 | 37 | 62 | 75 | 54 |
| 423601 | 2-13-5 | 28 | 38 | 58 | 75 | 51 |

TABLE 73

| ISIS No | Motif | 18.75 nM | 37.5 nM | 75.0 nM | 150.0 nM | IC$_{50}$ (nM) |
|---|---|---|---|---|---|---|
| 217317 | 5-10-5 | 4 | 23 | 39 | 61 | 104 |
| 217328 | 5-10-5 | 20 | 33 | 54 | 67 | 73 |
| 411899 | 5-10-5 | 11 | 34 | 51 | 66 | 74 |
| 413214 | 5-10-5 | 8 | 32 | 52 | 68 | 73 |
| 413232 | 5-10-5 | 17 | 26 | 50 | 70 | 71 |
| 423452 | 5-10-5 | 12 | 26 | 45 | 65 | 88 |
| 423453 | 5-10-5 | 15 | 33 | 46 | 67 | 76 |
| 423458 | 5-10-5 | 14 | 31 | 49 | 70 | 74 |
| 423459 | 5-10-5 | 17 | 29 | 61 | 73 | 64 |
| 423464 | 5-10-5 | 19 | 33 | 52 | 64 | 74 |
| 423507 | 3-14-3 | 15 | 32 | 52 | 68 | 73 |
| 423508 | 3-14-3 | 14 | 37 | 48 | 69 | 73 |
| 423526 | 3-14-3 | 13 | 23 | 41 | 58 | 109 |
| 423527 | 3-14-3 | 13 | 28 | 51 | 58 | 102 |
| 423565 | 2-13-5 | 17 | 27 | 48 | 69 | 80 |
| 423567 | 2-13-5 | 0 | 29 | 53 | 74 | 79 |
| 423585 | 2-13-5 | 12 | 25 | 42 | 64 | 94 |
| 423595 | 2-13-5 | 12 | 26 | 47 | 69 | 81 |
| 423606 | 2-13-5 | 13 | 27 | 55 | 71 | 68 |

The same gapmers were also tested at various doses in HepG2 cells using electroporation. Cells were plated at a density of 20,000 cells per well and transfected using electroporation with 2.5 µM, 5.0 µM, 10.0 µM, or 20.0 µM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration ($IC_{50}$) of each oligonucleotide is also presented. DGAT2 mRNA levels were significantly reduced in a dose-dependent manner in antisense oligonucleotide treated cells.

TABLE 74

| ISIS No | Motif | 2.5 µM | 5.0 µM | 10.0 µM | 20.0 µM | $IC_{50}$ (µM) |
|---|---|---|---|---|---|---|
| 217328 | 5-10-5 | 55 | 70 | 85 | 94 | 2 |
| 366730 | 5-10-5 | 38 | 51 | 78 | 89 | 5 |
| 411944 | 5-10-5 | 30 | 32 | 48 | 73 | 10 |
| 411945 | 5-10-5 | 31 | 26 | 48 | 69 | 11 |
| 413253 | 5-10-5 | 39 | 51 | 77 | 84 | 4 |
| 413433 | 5-10-5 | 72 | 81 | 82 | 85 | <2.5 |
| 423440 | 5-10-5 | 30 | 54 | 65 | 91 | 5 |
| 423441 | 5-10-5 | 41 | 47 | 60 | 90 | 6 |
| 423444 | 5-10-5 | 19 | 46 | 70 | 81 | 6 |
| 423447 | 5-10-5 | 25 | 49 | 76 | 79 | 5 |
| 423463 | 5-10-5 | 59 | 79 | 85 | 86 | 2 |
| 423489 | 3-14-3 | 33 | 56 | 72 | 92 | 5 |
| 423490 | 3-14-3 | 17 | 25 | 53 | 82 | 9 |
| 423498 | 3-14-3 | 30 | 41 | 59 | 88 | 7 |
| 423499 | 5-10-5 | 27 | 26 | 63 | 78 | 10 |
| 423523 | 3-14-3 | 45 | 48 | 81 | 89 | 5 |
| 423524 | 3-14-3 | 35 | 59 | 84 | 92 | 4 |
| 423601 | 2-13-5 | 44 | 55 | 87 | 90 | 4 |

TABLE 75

| ISIS No | Motif | 18.75 nM | 37.5 nM | 75.0 nM | 150.0 nM | $IC_{50}$ (nM) |
|---|---|---|---|---|---|---|
| 217317 | 5-10-5 | 16 | 33 | 63 | 65 | 7 |
| 217328 | 5-10-5 | 32 | 56 | 79 | 91 | 4 |
| 411899 | 5-10-5 | 28 | 38 | 74 | 87 | 5 |
| 413214 | 5-10-5 | 37 | 46 | 65 | 91 | 6 |
| 413232 | 5-10-5 | 18 | 20 | 43 | 78 | 11 |
| 423452 | 5-10-5 | 14 | 47 | 73 | 85 | 6 |
| 423453 | 5-10-5 | 52 | 70 | 83 | 93 | 2 |
| 423458 | 5-10-5 | 28 | 31 | 65 | 87 | 8 |
| 423459 | 5-10-5 | 24 | 33 | 57 | 88 | 8 |
| 423464 | 5-10-5 | 68 | 81 | 86 | 88 | 1 |
| 423507 | 3-14-3 | 29 | 42 | 71 | 89 | 5 |
| 423508 | 3-14-3 | 16 | 38 | 53 | 83 | 7 |
| 423526 | 3-14-3 | 48 | 73 | 81 | 90 | 3 |
| 423527 | 3-14-3 | 27 | 51 | 68 | 85 | 6 |
| 423565 | 2-13-5 | 13 | 35 | 66 | 84 | 7 |
| 423567 | 2-13-5 | 27 | 42 | 61 | 91 | 7 |
| 423585 | 2-13-5 | 24 | 28 | 67 | 91 | 7 |
| 423595 | 2-13-5 | 12 | 25 | 50 | 78 | 10 |
| 423606 | 2-13-5 | 42 | 59 | 74 | 85 | 3 |

Study 2

Cells were plated at a density of 35,000 cells per well and transfected using electroporation with 0.22 µM, 0.67 µM, 2.0 µM, 6.0 µM, or 18.0 µM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2977 MGB (forward sequence ACTGGGCGGGCTTCATATT, designated herein as SEQ ID NO: 10; reverse sequence CCCGGAGTAGGCGGCTAT, designated herein as SEQ ID NO: 11; probe sequence AGCCATGAAGACCC, designated herein as SEQ ID NO: 12) was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration ($IC_{50}$) of each oligonucleotide is also presented. DGAT2 mRNA levels were significantly reduced in a dose-dependent manner in antisense oligonucleotide treated cells.

TABLE 76

| ISIS No | Motif | 0.22 µM | 0.67 µM | 2.0 µM | 6.0 µM | 18.0 µM | $IC_{50}$ (µM) |
|---|---|---|---|---|---|---|---|
| 217328 | 5-10-5 | 0 | 17 | 52 | 83 | 96 | 2.1 |
| 366730 | 5-10-5 | 0 | 0 | 27 | 72 | 93 | 3.9 |
| 413433 | 5-10-5 | 0 | 10 | 58 | 84 | 93 | 2.2 |
| 423453 | 5-10-5 | 14 | 21 | 53 | 86 | 94 | 1.9 |
| 423459 | 5-10-5 | 0 | 18 | 36 | 68 | 92 | 3.0 |
| 423463 | 5-10-5 | 16 | 15 | 50 | 76 | 80 | 2.7 |
| 423464 | 5-10-5 | 0 | 29 | 56 | 86 | 92 | 1.6 |
| 423489 | 3-14-3 | 0 | 0 | 37 | 63 | 91 | 3.8 |
| 423498 | 3-14-3 | 0 | 0 | 21 | 56 | 82 | 5.3 |
| 423499 | 3-14-3 | 0 | 6 | 26 | 62 | 88 | 4.1 |
| 423523 | 3-14-3 | 0 | 0 | 34 | 69 | 95 | 4.2 |
| 423524 | 3-14-3 | 0 | 6 | 15 | 62 | 90 | 4.4 |
| 423526 | 3-14-3 | 5 | 7 | 45 | 87 | 94 | 2.6 |
| 423601 | 2-13-5 | 0 | 0 | 31 | 65 | 89 | 4.3 |
| 423606 | 2-13-5 | 58 | 19 | 43 | 72 | 94 | 2.6 |

Study 3

Cells were plated at a density of 10,000 cells per well and transfected using Lipofectin reagent with 12.5 nM, 25.0 nM, 50.0 nM, 100.0 nM, or 200.0 nM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration ($IC_{50}$) of each oligonucleotide is also presented. DGAT2 mRNA levels were significantly reduced in a dose-dependent manner in antisense oligonucleotide treated cells.

TABLE 77

| ISIS No | Motif | 0.22 µM | 0.67 µM | 2.0 µM | 6.0 µM | 18.0 µM | $IC_{50}$ (µM) |
|---|---|---|---|---|---|---|---|
| 217328 | 5-10-5 | 25 | 31 | 58 | 71 | 85 | 38 |
| 366730 | 5-10-5 | 21 | 34 | 53 | 74 | 90 | 44 |
| 413433 | 5-10-5 | 23 | 40 | 63 | 75 | 86 | 37 |
| 423453 | 5-10-5 | 0 | 2 | 33 | 61 | 72 | 90 |
| 423459 | 5-10-5 | 16 | 22 | 44 | 65 | 79 | 64 |
| 423463 | 5-10-5 | 6 | 24 | 46 | 63 | 82 | 62 |
| 423464 | 5-10-5 | 20 | 28 | 45 | 64 | 79 | 60 |
| 423489 | 3-14-3 | 15 | 28 | 57 | 75 | 84 | 42 |
| 423498 | 3-14-3 | 8 | 21 | 52 | 71 | 85 | 49 |
| 423499 | 3-14-3 | 13 | 23 | 43 | 65 | 84 | 62 |
| 423523 | 3-14-3 | 25 | 38 | 58 | 72 | 86 | 38 |
| 423524 | 3-14-3 | 16 | 32 | 56 | 66 | 83 | 52 |
| 423526 | 3-14-3 | 28 | 33 | 51 | 54 | 68 | 71 |

TABLE 77-continued

| ISIS No | Motif | 0.22 µM | 0.67 µM | 2.0 µM | 6.0 µM | 18.0 µM | IC$_{50}$ (µM) |
|---|---|---|---|---|---|---|---|
| 423601 | 2-13-5 | 13 | 30 | 54 | 71 | 84 | 49 |
| 423606 | 2-13-5 | 12 | 36 | 52 | 69 | 80 | 47 |

Study 4

Cells were plated at a density of 10,000 cells per well and transfected using Lipofectin reagent with 12.5 nM, 25.0 nM, 50.0 nM, 100.0 nM, or 200.0 nM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 78

| ISIS No | Motif | 0.22 µM | 0.67 µM | 2.0 µM | 6.0 µM | 18.0 µM | IC$_{50}$ (µM) |
|---|---|---|---|---|---|---|---|
| 217328 | 5-10-5 | 42 | 54 | 60 | 88 | 95 | 2 |
| 366730 | 5-10-5 | 26 | 44 | 61 | 85 | 95 | 3 |
| 413433 | 5-10-5 | 55 | 69 | 76 | 83 | 87 | <1.25 |
| 423453 | 5-10-5 | 40 | 62 | 78 | 91 | 95 | 2 |
| 423459 | 5-10-5 | 19 | 25 | 47 | 79 | 92 | 5 |
| 423463 | 5-10-5 | 51 | 52 | 83 | 86 | 90 | <1.25 |
| 423464 | 5-10-5 | 42 | 67 | 82 | 90 | 89 | 2 |
| 423489 | 3-14-3 | 8 | 19 | 40 | 77 | 96 | 5 |
| 423498 | 3-14-3 | 5 | 1 | 20 | 51 | 89 | 9 |
| 423499 | 3-14-3 | 23 | 24 | 35 | 71 | 95 | 5 |
| 423523 | 3-14-3 | 19 | 42 | 67 | 87 | 93 | 3 |
| 423524 | 3-14-3 | 38 | 53 | 71 | 90 | 95 | 2 |
| 423526 | 3-14-3 | 33 | 59 | 78 | 91 | 93 | 2 |
| 423601 | 2-13-5 | 22 | 45 | 72 | 88 | 93 | 3 |
| 423606 | 2-13-5 | 30 | 46 | 64 | 83 | 86 | 3 |

Study 5

Cells were plated at a density of 20,000 cells per well and transfected using electroporation with 12.5 µM, 25.0 µM, 50.0 µM, 100.0 µM, or 200.0 µM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB (forward sequence AACTGGCCCTGCGTCATG, designated herein as SEQ ID NO: 7; reverse sequence CTTGTACACTTCATTCTCTC-CAAAGG; designated herein as SEQ ID NO: 8; probe sequence CTGACCTGGTTCCC, designated herein as SEQ ID NO: 9) was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 79

| ISIS No | Motif | 12.5 µM | 25 µM | 50 µM | 100 µM | 200 µM | IC$_{50}$ (µM) |
|---|---|---|---|---|---|---|---|
| 217316 | 5-10-5 | 0 | 0 | 17 | 43 | 76 | 10.9 |
| 217318 | 5-10-5 | 0 | 0 | 10 | 48 | 45 | 18.4 |
| 217328 | 5-10-5 | 12 | 22 | 40 | 69 | 82 | 6.0 |
| 217376 | 5-10-5 | 0 | 0 | 51 | 50 | 70 | 9.8 |
| 381728 | 5-10-5 | 0 | 3 | 17 | 37 | 58 | 15.8 |
| 411896 | 5-10-5 | 5 | 16 | 52 | 73 | 87 | 5.5 |
| 411899 | 5-10-5 | 0 | 0 | 15 | 42 | 54 | 15.7 |
| 411900 | 5-10-5 | 0 | 0 | 18 | 38 | 76 | 11.5 |
| 411950 | 5-10-5 | 5 | 13 | 21 | 49 | 70 | 10.7 |
| 411951 | 5-10-5 | 0 | 10 | 31 | 52 | 76 | 8.9 |
| 413433 | 5-10-5 | 0 | 37 | 58 | 75 | 82 | 5.6 |
| 423453 | 5-10-5 | 16 | 21 | 41 | 73 | 86 | 5.5 |
| 423463 | 5-10-5 | 26 | 33 | 62 | 81 | 85 | 3.5 |
| 423464 | 5-10-5 | 21 | 43 | 58 | 82 | 84 | 3.4 |
| 423606 | 2-13-5 | 30 | 43 | 53 | 76 | 80 | 3.6 |

Study 6

Cells were plated at a density of 20,000 cells per well and transfected using electroporation with 0.625 µM, 1.25 µM, 2.5 µM, 5.0 µM, 10 µM, or 20 µM, concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 80

| ISIS No | Motif | 0.625 µM | 1.25 µM | 2.5 µM | 5.0 µM | 10.0 µM | 20.0 µM | IC$_{50}$ (µM) |
|---|---|---|---|---|---|---|---|---|
| 217317 | 5-10-5 | 11 | 18 | 39 | 59 | 79 | 94 | 3.5 |
| 217328 | 5-10-5 | 13 | 45 | 58 | 87 | 84 | 95 | 1.9 |
| 217376 | 5-10-5 | 10 | 9 | 4 | 28 | 12 | 11 | >20 |
| 217376 | 5-10-5 | 18 | 15 | 12 | 23 | 9 | 0 | >20 |
| 366730 | 5-10-5 | 14 | 23 | 55 | 74 | 86 | 97 | 2.6 |
| 411897 | 5-10-5 | 30 | 28 | 28 | 57 | 73 | 94 | 3.3 |
| 411901 | 5-10-5 | 19 | 22 | 30 | 58 | 76 | 93 | 4.0 |
| 411902 | 5-10-5 | 11 | 6 | 19 | 42 | 72 | 83 | 5.6 |
| 411947 | 5-10-5 | 14 | 14 | 10 | 35 | 66 | 87 | 7.1 |
| 411948 | 5-10-5 | 25 | 21 | 34 | 50 | 57 | 80 | 5.4 |
| 411950 | 5-10-5 | 7 | 24 | 41 | 56 | 74 | 83 | 3.9 |
| 411950 | 5-10-5 | 13 | 14 | 34 | 46 | 79 | 88 | 4.6 |
| 411951 | 5-10-5 | 28 | 18 | 22 | 43 | 83 | 92 | 5.4 |
| 411955 | 5-10-5 | 11 | 26 | 52 | 71 | 96 | 97 | 2.5 |
| 411958 | 5-10-5 | 19 | 17 | 21 | 60 | 81 | 92 | 4.7 |
| 413433 | 5-10-5 | 39 | 62 | 82 | 87 | 88 | 89 | 0.9 |
| 423463 | 5-10-5 | 15 | 36 | 76 | 87 | 92 | 90 | 1.7 |
| 423463 | 5-10-5 | 31 | 64 | 85 | 90 | 91 | 89 | 1.0 |
| 423489 | 3-14-3 | 21 | 17 | 39 | 73 | 89 | 98 | 3.2 |
| 423606 | 2-13-5 | 18 | 36 | 50 | 85 | 87 | 92 | 2.2 |

Example 8: Dose-Dependent Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. The antisense oligonucleotides were tested in a series of experiments that had similar culture conditions. The results for each experiment are presented in separate tables shown below. Cells were plated at a density of 20,000 cells per well and transfected using electroporation with 0.625 µM, 1.25 µM, 2.50 µM, 5.00 µM, or 10.00 µM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration ($IC_{50}$) of each oligonucleotide is also presented. DGAT2 mRNA levels were significantly reduced in a dose-dependent manner in antisense oligonucleotide treated cells.

TABLE 81

| ISIS No | 0.625 µM | 1.25 µM | 2.50 µM | 5.00 µM | 10.00 µM | $IC_{50}$ (µM) |
|---|---|---|---|---|---|---|
| 483817 | 47 | 71 | 82 | 89 | 90 | <0.6 |
| 483825 | 40 | 56 | 78 | 85 | 85 | 0.8 |
| 483828 | 45 | 69 | 75 | 70 | 76 | <0.6 |
| 483832 | 42 | 59 | 67 | 78 | 72 | 0.8 |
| 483834 | 26 | 38 | 64 | 86 | 90 | 1.6 |
| 483852 | 47 | 60 | 69 | 81 | 85 | 0.7 |
| 483866 | 76 | 77 | 82 | 86 | 86 | <0.6 |
| 483869 | 39 | 69 | 74 | 72 | 80 | 0.6 |
| 483873 | 46 | 71 | 78 | 82 | 87 | <0.6 |

TABLE 82

| ISIS No | 0.625 µM | 1.25 µM | 2.50 µM | 5.00 µM | 10.00 µM | $IC_{50}$ (µM) |
|---|---|---|---|---|---|---|
| 483811 | 29 | 34 | 58 | 87 | 87 | 1.7 |
| 483816 | 21 | 14 | 34 | 71 | 87 | 3.0 |
| 483831 | 34 | 37 | 55 | 81 | 83 | 1.7 |
| 483835 | 28 | 47 | 56 | 82 | 89 | 1.6 |
| 483840 | 4 | 17 | 49 | 75 | 81 | 2.9 |
| 483870 | 13 | 31 | 52 | 84 | 88 | 2.2 |
| 483889 | 21 | 0 | 56 | 81 | 85 | 2.7 |
| 483895 | 43 | 21 | 74 | 88 | 92 | 2.0 |
| 483898 | 46 | 47 | 81 | 89 | 86 | 0.8 |
| 483908 | 29 | 16 | 73 | 84 | 88 | 1.9 |
| 483910 | 31 | 39 | 73 | 79 | 76 | 1.5 |
| 483923 | 24 | 0 | 62 | 81 | 89 | 3.4 |
| 483952 | 63 | 67 | 86 | 91 | 89 | <0.6 |

TABLE 83

| ISIS No | 0.625 µM | 1.25 µM | 2.50 µM | 5.00 µM | 10.00 µM | $IC_{50}$ (µM) |
|---|---|---|---|---|---|---|
| 483968 | 39 | 55 | 76 | 89 | 88 | 0.9 |
| 483969 | 29 | 57 | 70 | 82 | 89 | 1.2 |
| 483970 | 16 | 48 | 62 | 71 | 85 | 1.9 |
| 483972 | 17 | 52 | 69 | 78 | 78 | 1.7 |
| 483984 | 53 | 74 | 85 | 83 | 78 | <0.6 |
| 483986 | 15 | 37 | 59 | 71 | 83 | 2.2 |
| 483987 | 9 | 0 | 76 | 78 | 91 | 1.5 |
| 483993 | 42 | 58 | 69 | 69 | 78 | 0.8 |
| 483996 | 20 | 46 | 53 | 63 | 74 | 2.3 |
| 483997 | 20 | 61 | 72 | 82 | 82 | 1.3 |
| 484004 | 27 | 57 | 65 | 74 | 83 | 1.4 |
| 484006 | 22 | 47 | 65 | 72 | 86 | 1.7 |
| 484010 | 27 | 0 | 51 | 78 | 86 | 2.0 |
| 484017 | 28 | 51 | 66 | 79 | 88 | 1.4 |

TABLE 84

| ISIS No | 0.625 µM | 1.25 µM | 2.50 µM | 5.00 µM | 10.00 µM | $IC_{50}$ (µM) |
|---|---|---|---|---|---|---|
| 413433 | 11 | 53 | 74 | 85 | 83 | 1.6 |
| 484012 | 19 | 36 | 49 | 76 | 88 | 2.2 |
| 484020 | 26 | 49 | 66 | 70 | 78 | 1.6 |
| 484041 | 12 | 45 | 51 | 68 | 80 | 2.4 |
| 484049 | 35 | 62 | 68 | 82 | 81 | 0.9 |
| 484094 | 20 | 37 | 52 | 62 | 74 | 2.7 |
| 484099 | 32 | 44 | 77 | 84 | 89 | 1.3 |
| 484111 | 22 | 50 | 65 | 54 | 80 | 2.0 |
| 484114 | 29 | 47 | 69 | 68 | 72 | 1.6 |
| 484118 | 10 | 42 | 60 | 74 | 84 | 2.1 |
| 484182 | 0 | 57 | 59 | 79 | 74 | 2.3 |

TABLE 85

| ISIS No | 0.625 µM | 1.25 µM | 2.50 µM | 5.00 µM | 10.00 µM | $IC_{50}$ (µM) |
|---|---|---|---|---|---|---|
| 413433 | 33 | 46 | 65 | 81 | 87 | 1.4 |
| 484109 | 17 | 1 | 46 | 65 | 83 | 3.3 |
| 484138 | 9 | 15 | 17 | 28 | 53 | >10 |
| 484139 | 14 | 21 | 60 | 75 | 90 | 2.3 |
| 484152 | 25 | 46 | 75 | 89 | 91 | 1.4 |
| 484175 | 10 | 15 | 21 | 35 | 43 | >10 |
| 484183 | 3 | 15 | 20 | 34 | 55 | >10 |
| 484203 | 23 | 35 | 54 | 70 | 75 | 2.3 |
| 484209 | 21 | 36 | 50 | 74 | 88 | 2.2 |
| 484215 | 42 | 45 | 59 | 84 | 91 | 1.2 |
| 484217 | 23 | 36 | 56 | 82 | 93 | 1.9 |
| 484231 | 34 | 0 | 72 | 79 | 82 | 1 |
| 423463 | 35 | 53 | 73 | 86 | 87 | 1.1 |

TABLE 86

| ISIS No | 0.625 µM | 1.25 µM | 2.50 µM | 5.00 µM | 10.00 µM | $IC_{50}$ (µM) |
|---|---|---|---|---|---|---|
| 413433 | 37 | 55 | 72 | 84 | 88 | 1 |
| 423464 | 41 | 62 | 79 | 92 | 90 | 0.7 |
| 484268 | 34 | 57 | 73 | 81 | 84 | 1 |
| 484269 | 24 | 47 | 64 | 67 | 75 | 1.8 |
| 484270 | 29 | 50 | 65 | 88 | 91 | 1.3 |
| 484271 | 43 | 66 | 81 | 88 | 84 | 0.6 |
| 484273 | 42 | 62 | 73 | 79 | 78 | 0.7 |
| 484283 | 26 | 0 | 61 | 85 | 93 | 1.6 |
| 484284 | 27 | 38 | 54 | 76 | 81 | 1.9 |
| 484292 | 31 | 31 | 53 | 81 | 91 | 1.8 |
| 484293 | 26 | 36 | 61 | 78 | 87 | 1.8 |
| 484327 | 24 | 48 | 48 | 67 | 79 | 2.1 |
| 484342 | 21 | 34 | 48 | 67 | 88 | 2.4 |
| 484387 | 21 | 0 | 21 | 40 | 58 | 9.6 |
| 484396 | 15 | 13 | 18 | 24 | 44 | >10 |

TABLE 87

| ISIS No | 0.625 µM | 1.25 µM | 2.50 µM | 5.00 µM | 10.00 µM | $IC_{50}$ (µM) |
|---|---|---|---|---|---|---|
| 413433 | 30 | 57 | 80 | 81 | 86 | 1.1 |
| 484345 | 17 | 28 | 68 | 60 | 79 | 2.4 |
| 484354 | 20 | 28 | 75 | 60 | 79 | 2.2 |

TABLE 87-continued

| ISIS No | 0.625 μM | 1.25 μM | 2.50 μM | 5.00 μM | 10.00 μM | IC$_{50}$ (μM) |
|---|---|---|---|---|---|---|
| 484366 | 25 | 33 | 37 | 62 | 82 | 2.8 |
| 484368 | 16 | 39 | 57 | 73 | 89 | 2.1 |
| 484369 | 22 | 18 | 57 | 27 | 35 | >10 |
| 484372 | 3 | 28 | 37 | 69 | 76 | 3.3 |
| 484376 | 12 | 0 | 52 | 64 | 67 | 3.1 |
| 484379 | 0 | 19 | 21 | 37 | 75 | 5.6 |
| 484380 | 0 | 26 | 34 | 47 | 71 | 4.7 |
| 484395 | 7 | 41 | 61 | 29 | 46 | >10 |
| 484397 | 0 | 7 | 52 | 16 | 34 | >10 |
| 484406 | 17 | 6 | 53 | 39 | 53 | 7.5 |
| 484408 | 4 | 0 | 16 | 24 | 38 | >10 |
| 484409 | 0 | 6 | 0 | 41 | 59 | 9.0 |

TABLE 88

| ISIS No | 0.625 μM | 1.25 μM | 2.50 μM | 5.00 μM | 10.00 μM | IC$_{50}$ (μM) |
|---|---|---|---|---|---|---|
| 413433 | 22 | 51 | 68 | 72 | 88 | 1.6 |
| 472316 | 15 | 45 | 45 | 82 | 89 | 2.1 |
| 472317 | 34 | 30 | 43 | 77 | 91 | 2.0 |
| 472318 | 22 | 38 | 52 | 68 | 85 | 2.2 |
| 472444 | 22 | 27 | 41 | 39 | 74 | 4.4 |
| 472447 | 0 | 18 | 16 | 18 | 69 | 9.0 |
| 472456 | 10 | 10 | 48 | 51 | 68 | 4.3 |
| 472480 | 7 | 0 | 41 | 59 | 87 | 3.0 |
| 472481 | 29 | 29 | 37 | 62 | 84 | 2.7 |
| 472482 | 16 | 29 | 42 | 67 | 85 | 2.7 |
| 472484 | 23 | 19 | 51 | 72 | 87 | 2.4 |
| 472486 | 28 | 40 | 59 | 83 | 90 | 1.7 |
| 472488 | 27 | 31 | 36 | 53 | 64 | 4.4 |
| 472496 | 0 | 0 | 37 | 51 | 76 | 3.8 |
| 484410 | 0 | 40 | 19 | 24 | 39 | >10 |

TABLE 89

| ISIS No | 0.625 μM | 1.25 μM | 2.50 μM | 5.00 μM | 10.00 μM | IC$_{50}$ (μM) |
|---|---|---|---|---|---|---|
| 413433 | 37 | 51 | 70 | 84 | 88 | 1.1 |
| 472548 | 15 | 30 | 25 | 54 | 78 | 3.9 |
| 472552 | 15 | 28 | 33 | 51 | 66 | 4.7 |
| 472570 | 29 | 46 | 56 | 83 | 90 | 1.6 |
| 472571 | 29 | 34 | 53 | 70 | 86 | 2 |
| 411955 | 0 | 41 | 46 | 68 | 85 | 2.2 |
| 472608 | 28 | 26 | 56 | 59 | 72 | 2.7 |
| 472610 | 18 | 0 | 51 | 70 | 79 | 2.6 |
| 472637 | 24 | 37 | 39 | 53 | 72 | 3.4 |
| 472652 | 18 | 43 | 55 | 71 | 81 | 2.1 |
| 472725 | 35 | 46 | 61 | 77 | 86 | 1.4 |
| 472733 | 39 | 34 | 41 | 63 | 74 | 2.5 |
| 472738 | 38 | 53 | 65 | 81 | 85 | 1.1 |
| 472793 | 0 | 0 | 51 | 67 | 75 | 2 |
| 472811 | 0 | 44 | 65 | 78 | 77 | 1.4 |

TABLE 90

| ISIS No | 0.625 μM | 1.25 μM | 2.50 μM | 5.00 μM | 10.00 μM | IC$_{50}$ (μM) |
|---|---|---|---|---|---|---|
| 413433 | 0 | 47 | 72 | 84 | 88 | 2 |
| 472316 | 21 | 42 | 69 | 86 | 94 | 2 |
| 484152 | 20 | 57 | 79 | 90 | 93 | 1 |
| 484215 | 33 | 39 | 70 | 91 | 95 | 1 |
| 484217 | 19 | 18 | 49 | 89 | 94 | 2 |
| 484231 | 4 | 52 | 76 | 83 | 91 | 2 |
| 423463 | 33 | 54 | 79 | 91 | 91 | 1 |
| 423464 | 0 | 48 | 78 | 83 | 88 | 3 |
| 484268 | 0 | 3 | 0 | 13 | 50 | >10 |
| 484270 | 7 | 36 | 49 | 80 | 83 | 2 |

TABLE 90-continued

| ISIS No | 0.625 μM | 1.25 μM | 2.50 μM | 5.00 μM | 10.00 μM | IC$_{50}$ (μM) |
|---|---|---|---|---|---|---|
| 484271 | 16 | 59 | 76 | 86 | 91 | 1 |
| 484283 | 10 | 35 | 56 | 87 | 92 | 2 |
| 484369 | 25 | 1 | 0 | 5 | 33 | >10 |

TABLE 91

| ISIS No | 0.625 μM | 1.25 μM | 2.50 μM | 5.00 μM | 10.00 μM | IC$_{50}$ (μM) |
|---|---|---|---|---|---|---|
| 413433 | 28 | 60 | 69 | 84 | 92 | 1 |
| 483811 | 0 | 19 | 53 | 77 | 85 | 3 |
| 483817 | 47 | 69 | 85 | 88 | 94 | <0.6 |
| 483825 | 18 | 50 | 80 | 82 | 87 | 1 |
| 483834 | 16 | 37 | 72 | 89 | 87 | 2 |
| 483835 | 1 | 29 | 56 | 80 | 85 | 2 |
| 483866 | 55 | 79 | 88 | 83 | 90 | <0.6 |
| 483873 | 27 | 75 | 87 | 86 | 91 | 1 |
| 483898 | 49 | 72 | 82 | 89 | 89 | <0.6 |
| 483908 | 35 | 45 | 76 | 89 | 88 | 1 |
| 483913 | 0 | 42 | 76 | 86 | 89 | 2 |

TABLE 92

| ISIS No | 0.625 μM | 1.25 μM | 2.50 μM | 5.00 μM | 10.00 μM | IC$_{50}$ (μM) |
|---|---|---|---|---|---|---|
| 413433 | 47 | 68 | 84 | 90 | 88 | <0.6 |
| 423453 | 36 | 66 | 81 | 95 | 96 | 0.8 |
| 472158 | 56 | 51 | 75 | 91 | 96 | 0.6 |
| 472725 | 43 | 59 | 63 | 78 | 80 | 0.8 |
| 472738 | 38 | 58 | 65 | 77 | 81 | 1 |
| 483895 | 35 | 53 | 76 | 92 | 93 | 1.0 |
| 483923 | 26 | 46 | 76 | 88 | 92 | 1.3 |
| 483952 | 60 | 82 | 88 | 93 | 92 | <0.6 |
| 483968 | 46 | 70 | 82 | 91 | 93 | <0.6 |
| 483984 | 39 | 67 | 87 | 88 | 88 | 0.6 |
| 483987 | 40 | 60 | 75 | 90 | 95 | 0.9 |
| 483997 | 50 | 63 | 73 | 90 | 92 | 0.6 |
| 484099 | 56 | 75 | 88 | 93 | 95 | <0.6 |

TABLE 93

| ISIS No | 0.625 μM | 1.25 μM | 2.50 μM | 5.00 μM | 10.00 μM | IC$_{50}$ (μM) |
|---|---|---|---|---|---|---|
| 413433 | 26 | 53 | 75 | 86 | 91 | 1.3 |
| 495429 | 8 | 42 | 68 | 86 | 92 | 1.9 |
| 495449 | 19 | 53 | 74 | 87 | 86 | 1.4 |
| 495450 | 30 | 58 | 74 | 87 | 93 | 1.1 |
| 495470 | 0 | 36 | 59 | 82 | 92 | 2.2 |
| 495481 | 15 | 39 | 75 | 84 | 86 | 1.7 |
| 495484 | 19 | 50 | 73 | 87 | 87 | 1.5 |
| 495488 | 5 | 32 | 45 | 67 | 86 | 2.8 |
| 495489 | 13 | 36 | 54 | 81 | 91 | 2.1 |
| 495490 | 20 | 42 | 66 | 83 | 88 | 1.7 |
| 495492 | 5 | 38 | 64 | 81 | 90 | 2.1 |
| 495495 | 29 | 32 | 62 | 78 | 90 | 1.8 |
| 495496 | 21 | 44 | 62 | 79 | 92 | 1.7 |
| 495497 | 20 | 42 | 59 | 69 | 88 | 2.0 |
| 495498 | 21 | 54 | 68 | 81 | 90 | 1.5 |

TABLE 94

| ISIS No | 0.625 μM | 1.25 μM | 2.50 μM | 5.00 μM | 10.00 μM | IC$_{50}$ (μM) |
|---|---|---|---|---|---|---|
| 413433 | 35 | 42 | 73 | 86 | 90 | 1.3 |
| 495442 | 6 | 29 | 43 | 68 | 80 | 3.0 |

TABLE 94-continued

| ISIS No | 0.625 μM | 1.25 μM | 2.50 μM | 5.00 μM | 10.00 μM | IC$_{50}$ (μM) |
|---|---|---|---|---|---|---|
| 495451 | 21 | 31 | 51 | 76 | 87 | 2.2 |
| 495453 | 21 | 34 | 64 | 80 | 84 | 1.9 |
| 495454 | 23 | 33 | 53 | 80 | 86 | 2.1 |
| 495463 | 4 | 28 | 53 | 74 | 85 | 2.6 |
| 495464 | 21 | 41 | 65 | 84 | 84 | 1.7 |
| 495466 | 12 | 35 | 57 | 76 | 84 | 2.2 |
| 495467 | 17 | 28 | 44 | 69 | 89 | 2.6 |
| 495469 | 17 | 24 | 53 | 81 | 83 | 2.4 |
| 495471 | 29 | 43 | 58 | 83 | 84 | 1.6 |
| 495472 | 4 | 38 | 63 | 78 | 80 | 2.3 |
| 495482 | 7 | 32 | 52 | 76 | 91 | 2.4 |
| 495485 | 8 | 29 | 55 | 76 | 76 | 2.6 |
| 495491 | 25 | 42 | 64 | 85 | 92 | 1.6 |

TABLE 95

| ISIS No | 0.625 μM | 1.25 μM | 2.50 μM | 5.00 μM | 10.00 μM | IC$_{50}$ (μM) |
|---|---|---|---|---|---|---|
| 413433 | 40 | 48 | 75 | 86 | 86 | 1 |
| 495430 | 0 | 5 | 11 | 47 | 67 | 6.2 |
| 495441 | 17 | 17 | 55 | 77 | 87 | 2.5 |
| 495443 | 28 | 51 | 59 | 74 | 84 | 1.6 |
| 495448 | 13 | 28 | 32 | 61 | 79 | 3.4 |
| 495452 | 13 | 51 | 47 | 71 | 78 | 2.3 |
| 495462 | 46 | 47 | 51 | 76 | 84 | 1.2 |
| 495465 | 2 | 20 | 35 | 68 | 78 | 3.5 |
| 495468 | 22 | 20 | 46 | 56 | 84 | 3 |
| 495473 | 11 | 24 | 48 | 69 | 75 | 3 |
| 495479 | 19 | 29 | 54 | 76 | 85 | 2.2 |
| 495483 | 15 | 9 | 47 | 77 | 88 | 2.7 |
| 495516 | 49 | 76 | 89 | 90 | 93 | <0.6 |
| 495562 | 20 | 55 | 70 | 88 | 92 | 1.4 |
| 495576 | 51 | 69 | 88 | 93 | 94 | <0.6 |

TABLE 96

| ISIS No | 0.625 μM | 1.25 μM | 2.50 μM | 5.00 μM | 10.00 μM | IC$_{50}$ (μM) |
|---|---|---|---|---|---|---|
| 413433 | 34 | 51 | 71 | 86 | 89 | 1.1 |
| 495505 | 34 | 58 | 80 | 87 | 91 | 1.0 |
| 495517 | 19 | 55 | 78 | 85 | 91 | 1.3 |
| 495518 | 24 | 51 | 72 | 87 | 90 | 1.4 |
| 495519 | 33 | 46 | 70 | 86 | 90 | 1.3 |
| 495520 | 63 | 84 | 89 | 90 | 91 | <0.6 |
| 495522 | 45 | 32 | 54 | 82 | 89 | 1.5 |
| 495523 | 14 | 46 | 66 | 86 | 91 | 1.7 |
| 495524 | 12 | 39 | 60 | 84 | 93 | 1.9 |
| 495554 | 35 | 64 | 75 | 89 | 90 | 0.9 |
| 495555 | 42 | 49 | 72 | 87 | 91 | 1 |
| 495563 | 35 | 41 | 66 | 84 | 91 | 1.4 |
| 495571 | 21 | 41 | 67 | 87 | 93 | 1.6 |
| 495575 | 33 | 43 | 62 | 82 | 84 | 1.5 |
| 495577 | 33 | 56 | 71 | 85 | 91 | 1.1 |

TABLE 97

| ISIS No | 0.625 μM | 1.25 μM | 2.50 μM | 5.00 μM | 10.00 μM | IC$_{50}$ (μM) |
|---|---|---|---|---|---|---|
| 413433 | 39 | 52 | 66 | 81 | 87 | 1.1 |
| 495570 | 27 | 50 | 55 | 78 | 89 | 1.6 |
| 495650 | 0 | 38 | 58 | 65 | 85 | 2.7 |
| 495561 | 24 | 54 | 71 | 87 | 92 | 1.3 |
| 495618 | 0 | 35 | 50 | 79 | 87 | 2.5 |
| 495540 | 11 | 35 | 48 | 74 | 88 | 2.4 |
| 495649 | 0 | 24 | 43 | 76 | 82 | 3.1 |
| 495515 | 22 | 45 | 69 | 83 | 91 | 1.6 |
| 495599 | 25 | 23 | 42 | 73 | 86 | 2.5 |

TABLE 97-continued

| ISIS No | 0.625 μM | 1.25 μM | 2.50 μM | 5.00 μM | 10.00 μM | IC$_{50}$ (μM) |
|---|---|---|---|---|---|---|
| 495620 | 27 | 54 | 63 | 85 | 91 | 1.4 |
| 495606 | 16 | 27 | 56 | 80 | 90 | 2.2 |
| 495604 | 31 | 48 | 77 | 83 | 90 | 1.2 |
| 495609 | 52 | 66 | 80 | 84 | 90 | <0.6 |
| 495619 | 29 | 42 | 63 | 73 | 90 | 1.6 |
| 495621 | 0 | 28 | 31 | 69 | 84 | 3.3 |

TABLE 98

| ISIS No | 0.625 μM | 1.25 μM | 2.50 μM | 5.00 μM | 10.00 μM | IC$_{50}$ (μM) |
|---|---|---|---|---|---|---|
| 413433 | 19 | 24 | 66 | 81 | 88 | 2.1 |
| 495591 | 7 | 24 | 43 | 66 | 82 | 3.0 |
| 495744 | 25 | 41 | 51 | 73 | 84 | 2.0 |
| 495685 | 34 | 58 | 73 | 84 | 83 | 1.0 |
| 495738 | 26 | 41 | 61 | 81 | 83 | 1.7 |
| 495707 | 33 | 46 | 61 | 76 | 72 | 1.5 |
| 495837 | 30 | 33 | 67 | 90 | 94 | 1.6 |
| 495752 | 14 | 30 | 68 | 86 | 91 | 1.9 |
| 495839 | 15 | 67 | 83 | 90 | 91 | 1.2 |
| 495736 | 28 | 41 | 65 | 83 | 85 | 1.6 |
| 495840 | 39 | 59 | 78 | 92 | 93 | 0.8 |
| 495753 | 43 | 48 | 69 | 87 | 97 | 1.0 |
| 495878 | 34 | 62 | 78 | 92 | 96 | 0.9 |
| 495749 | 21 | 23 | 52 | 84 | 89 | 2.2 |
| 495756 | 24 | 29 | 58 | 80 | 89 | 2.0 |

TABLE 99

| ISIS No | 0.625 μM | 1.25 μM | 2.50 μM | 5.00 μM | 10.00 μM | IC$_{50}$ (μM) |
|---|---|---|---|---|---|---|
| 413433 | 28 | 60 | 70 | 83 | 84 | 1.1 |
| 495853 | 39 | 51 | 78 | 92 | 96 | 1 |
| 495857 | 41 | 49 | 67 | 87 | 91 | 1.1 |
| 495829 | 41 | 68 | 81 | 90 | 90 | 0.6 |
| 495818 | 12 | 38 | 57 | 77 | 93 | 2.1 |
| 495842 | 40 | 67 | 80 | 88 | 91 | 0.7 |
| 495849 | 37 | 53 | 66 | 79 | 82 | 1.1 |
| 495836 | 16 | 54 | 63 | 80 | 88 | 1.6 |
| 495875 | 22 | 58 | 63 | 80 | 93 | 1.4 |
| 495841 | 43 | 66 | 76 | 87 | 90 | 0.6 |
| 495819 | 13 | 38 | 54 | 74 | 90 | 2.2 |
| 495825 | 36 | 52 | 69 | 88 | 93 | 1.1 |
| 495832 | 20 | 50 | 65 | 78 | 85 | 1.6 |
| 495809 | 16 | 37 | 46 | 78 | 85 | 2.3 |
| 495876 | 19 | 39 | 65 | 86 | 95 | 1.7 |

TABLE 100

| ISIS No | 0.625 μM | 1.25 μM | 2.50 μM | 5.00 μM | 10.00 μM | IC$_{50}$ (μM) |
|---|---|---|---|---|---|---|
| 413433 | 46 | 61 | 82 | 86 | 86 | 0.6 |
| 496037 | 23 | 38 | 57 | 74 | 93 | 1.9 |
| 496038 | 10 | 31 | 42 | 67 | 93 | 2.6 |
| 496039 | 9 | 19 | 35 | 67 | 88 | 3.1 |
| 496040 | 4 | 38 | 45 | 70 | 88 | 2.6 |
| 496041 | 21 | 30 | 50 | 84 | 95 | 2.1 |
| 496043 | 2 | 26 | 58 | 80 | 87 | 2.4 |
| 495826 | 7 | 44 | 72 | 82 | 85 | 1.9 |
| 495868 | 27 | 38 | 75 | 83 | 85 | 1.5 |
| 495901 | 18 | 46 | 69 | 79 | 83 | 1.7 |
| 495902 | 20 | 48 | 66 | 82 | 85 | 1.6 |
| 495955 | 3 | 3 | 54 | 66 | 75 | 3.5 |
| 495992 | 26 | 43 | 74 | 86 | 92 | 1.4 |
| 496100 | 20 | 30 | 56 | 71 | 85 | 2.3 |
| 496104 | 37 | 35 | 48 | 72 | 81 | 1.9 |

TABLE 101

| ISIS No | 0.625 μM | 1.25 μM | 2.50 μM | 5.00 μM | 10.00 μM | IC$_{50}$ (μM) |
|---|---|---|---|---|---|---|
| 413433 | 33 | 49 | 70 | 75 | 90 | 1.3 |
| 501838 | 32 | 52 | 67 | 73 | 71 | 1.3 |
| 501849 | 39 | 63 | 76 | 85 | 93 | 0.8 |
| 501850 | 29 | 59 | 72 | 88 | 92 | 1.1 |
| 501852 | 43 | 63 | 75 | 80 | 87 | 0.7 |
| 501855 | 57 | 70 | 87 | 90 | 92 | <0.6 |
| 501861 | 39 | 63 | 80 | 90 | 93 | 0.8 |
| 501871 | 28 | 53 | 76 | 84 | 93 | 1.2 |
| 501883 | 33 | 45 | 62 | 73 | 82 | 1.5 |
| 501884 | 41 | 59 | 75 | 86 | 92 | 0.8 |
| 501886 | 42 | 63 | 71 | 78 | 84 | 0.7 |
| 501890 | 32 | 49 | 61 | 72 | 79 | 1.5 |
| 501932 | 38 | 49 | 68 | 80 | 85 | 1.1 |
| 501944 | 30 | 43 | 69 | 80 | 87 | 1.4 |
| 501950 | 32 | 49 | 70 | 72 | 91 | 1.3 |

TABLE 102

| ISIS No | 0.625 μM | 1.25 μM | 2.50 μM | 5.00 μM | 10.00 μM | IC$_{50}$ (μM) |
|---|---|---|---|---|---|---|
| 413433 | 35 | 53 | 69 | 86 | 91 | 1.1 |
| 501903 | 32 | 39 | 62 | 80 | 90 | 1.6 |
| 501916 | 29 | 42 | 61 | 78 | 88 | 1.6 |
| 501933 | 37 | 51 | 66 | 75 | 77 | 1.2 |
| 501934 | 26 | 41 | 52 | 69 | 82 | 2 |
| 501946 | 15 | 34 | 57 | 76 | 90 | 2.1 |
| 501947 | 35 | 54 | 74 | 87 | 93 | 1.1 |
| 501951 | 36 | 54 | 75 | 85 | 93 | 1 |
| 501957 | 27 | 41 | 67 | 76 | 86 | 1.7 |
| 501959 | 40 | 52 | 72 | 81 | 87 | 1 |
| 501960 | 35 | 52 | 67 | 82 | 90 | 1.2 |
| 501966 | 34 | 42 | 64 | 75 | 84 | 1.5 |
| 501968 | 29 | 49 | 73 | 84 | 91 | 1.3 |
| 501977 | 19 | 28 | 49 | 74 | 88 | 2.3 |
| 502040 | 24 | 38 | 54 | 73 | 88 | 2 |

TABLE 103

| ISIS No | 0.625 μM | 1.25 μM | 2.50 μM | 5.00 μM | 10.00 μM | IC$_{50}$ (μM) |
|---|---|---|---|---|---|---|
| 413433 | 37 | 53 | 72 | 83 | 39 | 1.1 |
| 501981 | 21 | 43 | 62 | 79 | 90 | 1.7 |
| 501982 | 28 | 53 | 64 | 70 | 82 | 1.5 |
| 501983 | 29 | 41 | 57 | 75 | 84 | 1.8 |
| 502013 | 24 | 42 | 60 | 74 | 80 | 1.9 |
| 502015 | 19 | 39 | 57 | 63 | 71 | 2.5 |
| 502025 | 22 | 48 | 59 | 78 | 89 | 1.7 |
| 502026 | 21 | 39 | 56 | 77 | 86 | 2 |
| 502037 | 15 | 13 | 38 | 56 | 87 | 3.4 |
| 502038 | 3 | 14 | 52 | 55 | 77 | 3.5 |
| 502045 | 45 | 47 | 63 | 75 | 85 | 1.1 |
| 502046 | 21 | 37 | 50 | 71 | 81 | 2.3 |
| 502056 | 44 | 67 | 82 | 86 | 41 | 0.6 |
| 502083 | 37 | 55 | 76 | 89 | 93 | 1 |
| 502119 | 37 | 60 | 77 | 88 | 92 | 0.9 |

TABLE 104

| ISIS No | 0.625 μM | 1.25 μM | 2.50 μM | 5.00 μM | 10.00 μM | IC$_{50}$ (μM) |
|---|---|---|---|---|---|---|
| 413433 | 40 | 58 | 77 | 88 | 91 | 0.8 |
| 502075 | 30 | 47 | 69 | 82 | 91 | 1.4 |
| 502098 | 37 | 59 | 74 | 88 | 94 | 0.9 |
| 502099 | 43 | 59 | 76 | 88 | 94 | 0.8 |
| 502154 | 64 | 72 | 84 | 88 | 90 | <0.6 |
| 502155 | 34 | 54 | 72 | 82 | 87 | 1.1 |
| 502156 | 17 | 38 | 57 | 83 | 87 | 2 |

TABLE 104-continued

| ISIS No | 0.625 μM | 1.25 μM | 2.50 μM | 5.00 μM | 10.00 μM | IC$_{50}$ (μM) |
|---|---|---|---|---|---|---|
| 502163 | 41 | 60 | 82 | 92 | 93 | 0.7 |
| 502164 | 41 | 73 | 78 | 89 | 90 | 0.6 |
| 502175 | 33 | 58 | 74 | 87 | 90 | 1 |
| 502179 | 61 | 74 | 81 | 87 | 87 | <0.6 |
| 502189 | 33 | 52 | 79 | 91 | 94 | 1.1 |
| 502191 | 53 | 67 | 84 | 92 | 92 | <0.6 |
| 502194 | 48 | 64 | 83 | 87 | 92 | <0.6 |
| 502228 | 34 | 47 | 67 | 80 | 89 | 1.3 |

TABLE 105

| ISIS No | 0.625 μM | 1.25 μM | 2.50 μM | 5.00 μM | 10.00 μM | IC$_{50}$ (μM) |
|---|---|---|---|---|---|---|
| 413433 | 24 | 28 | 51 | 68 | 83 | 2.4 |
| 495756 | 49 | 71 | 87 | 88 | 94 | <0.6 |
| 507692 | 48 | 70 | 83 | 88 | 93 | <0.6 |
| 507693 | 48 | 68 | 86 | 91 | 93 | <0.6 |
| 507694 | 41 | 61 | 81 | 88 | 93 | 0.7 |
| 507695 | 36 | 53 | 72 | 84 | 93 | 1.1 |
| 507696 | 51 | 74 | 83 | 89 | 94 | <0.6 |
| 507710 | 48 | 72 | 71 | 90 | 91 | <0.6 |
| 507716 | 42 | 54 | 83 | 91 | 95 | 0.8 |
| 507717 | 44 | 65 | 79 | 86 | 90 | 0.6 |
| 502314 | 25 | 38 | 61 | 79 | 93 | 1.7 |
| 502319 | 47 | 66 | 80 | 92 | 94 | 0.6 |
| 502322 | 45 | 69 | 81 | 89 | 86 | <0.6 |
| 502331 | 34 | 45 | 53 | 71 | 89 | 1.6 |
| 502334 | 52 | 68 | 77 | 89 | 93 | <0.6 |

TABLE 106

| ISIS No | 0.625 μM | 1.25 μM | 2.50 μM | 5.00 μM | 10.00 μM | IC$_{50}$ (μM) |
|---|---|---|---|---|---|---|
| 413433 | 30 | 49 | 73 | 87 | 90 | 1.2 |
| 522366 | 32 | 53 | 68 | 80 | 84 | 1.2 |
| 522373 | 39 | 62 | 81 | 87 | 91 | 0.8 |
| 522374 | 39 | 50 | 71 | 85 | 91 | 1.1 |
| 522375 | 23 | 49 | 73 | 87 | 91 | 1.4 |
| 522383 | 46 | 64 | 79 | 83 | 85 | <0.6 |
| 522435 | 39 | 62 | 76 | 86 | 88 | 0.8 |
| 522437 | 33 | 62 | 78 | 87 | 90 | 0.9 |
| 522444 | 37 | 69 | 81 | 88 | 92 | 0.7 |
| 522445 | 62 | 54 | 68 | 85 | 91 | <0.6 |
| 522450 | 29 | 46 | 69 | 86 | 86 | 1.4 |
| 522473 | 19 | 33 | 66 | 78 | 86 | 2 |
| 522484 | 63 | 72 | 81 | 80 | 81 | <0.6 |
| 522485 | 37 | 43 | 70 | 82 | 90 | 1.3 |
| 522501 | 38 | 66 | 79 | 84 | 86 | 0.7 |

TABLE 107

| ISIS No | 0.625 μM | 1.25 μM | 2.50 μM | 5.00 μM | 10.00 μM | IC$_{50}$ (μM) |
|---|---|---|---|---|---|---|
| 413433 | 20 | 48 | 75 | 84 | 89 | 1.5 |
| 522440 | 31 | 51 | 69 | 79 | 85 | 1.3 |
| 522465 | 26 | 45 | 68 | 81 | 89 | 1.5 |
| 522474 | 17 | 40 | 65 | 78 | 87 | 1.9 |
| 522495 | 15 | 28 | 69 | 82 | 85 | 2 |
| 522509 | 24 | 38 | 61 | 88 | 87 | 1.7 |
| 522529 | 21 | 38 | 68 | 58 | 87 | 2 |
| 522553 | 15 | 29 | 61 | 81 | 90 | 2.1 |
| 522579 | 23 | 43 | 58 | 83 | 89 | 1.7 |
| 522580 | 50 | 36 | 68 | 84 | 93 | 1.1 |
| 522581 | 16 | 21 | 59 | 82 | 92 | 2.2 |
| 522582 | 23 | 48 | 59 | 86 | 91 | 1.6 |
| 522587 | 21 | 52 | 69 | 90 | 95 | 1.4 |

TABLE 107-continued

| ISIS No | 0.625 μM | 1.25 μM | 2.50 μM | 5.00 μM | 10.00 μM | IC$_{50}$ (μM) |
|---|---|---|---|---|---|---|
| 522588 | 19 | 41 | 65 | 88 | 94 | 1.7 |
| 522589 | 38 | 57 | 80 | 96 | 92 | 0.9 |

TABLE 108

| ISIS No | 0.625 μM | 1.25 μM | 2.50 μM | 5.00 μM | 10.00 μM | IC$_{50}$ (μM) |
|---|---|---|---|---|---|---|
| 413433 | 34 | 49 | 77 | 79 | 91 | 1.2 |
| 522550 | 16 | 45 | 58 | 80 | 89 | 1.9 |
| 522554 | 26 | 39 | 60 | 71 | 87 | 1.9 |
| 522555 | 38 | 50 | 66 | 74 | 81 | 1.2 |
| 522556 | 33 | 39 | 59 | 76 | 85 | 1.7 |
| 522609 | 41 | 67 | 87 | 92 | 84 | 0.6 |
| 522610 | 21 | 41 | 65 | 71 | 93 | 1.8 |
| 522621 | 35 | 54 | 71 | 85 | 94 | 1.1 |
| 522627 | 18 | 9 | 57 | 81 | 95 | 2.3 |
| 522631 | 26 | 34 | 70 | 81 | 93 | 1.7 |
| 522632 | 40 | 55 | 82 | 91 | 95 | 0.8 |
| 522638 | 8 | 33 | 63 | 74 | 91 | 2.2 |
| 522643 | 64 | 53 | 69 | 82 | 93 | <0.6 |
| 522667 | 23 | 55 | 75 | 86 | 91 | 1.3 |
| 522688 | 45 | 57 | 80 | 88 | 94 | 0.7 |

TABLE 109

| ISIS No | 0.625 μM | 1.25 μM | 2.50 μM | 5.00 μM | 10.00 μM | IC$_{50}$ (μM) |
|---|---|---|---|---|---|---|
| 413433 | 33 | 51 | 73 | 80 | 86 | 1.2 |
| 522672 | 20 | 20 | 57 | 89 | 93 | 2.1 |
| 522675 | 20 | 29 | 63 | 78 | 94 | 2 |
| 522676 | 6 | 43 | 62 | 88 | 93 | 1.9 |
| 522677 | 6 | 39 | 63 | 83 | 96 | 2 |
| 522679 | 17 | 35 | 62 | 82 | 92 | 1.9 |
| 522682 | 61 | 57 | 69 | 86 | 90 | <0.6 |
| 522689 | 29 | 57 | 78 | 87 | 93 | 1.1 |
| 522694 | 28 | 33 | 57 | 76 | 92 | 1.8 |
| 522697 | 19 | 31 | 68 | 86 | 95 | 1.8 |
| 522698 | 20 | 54 | 72 | 85 | 93 | 1.4 |
| 522715 | 12 | 48 | 68 | 80 | 88 | 1.8 |
| 522716 | 25 | 35 | 67 | 84 | 90 | 1.7 |
| 522717 | 27 | 56 | 74 | 90 | 88 | 1.2 |
| 522745 | 42 | 62 | 85 | 90 | 92 | 0.7 |

TABLE 110

| ISIS No | 0.625 μM | 1.25 μM | 2.50 μM | 5.00 μM | 10.00 μM | IC$_{50}$ (μM) |
|---|---|---|---|---|---|---|
| 413433 | 34 | 52 | 78 | 84 | 91 | 1.1 |
| 522671 | 36 | 43 | 72 | 85 | 92 | 1.2 |
| 522678 | 35 | 43 | 65 | 83 | 92 | 1.3 |
| 522680 | 25 | 50 | 63 | 82 | 86 | 1.5 |
| 522681 | 26 | 57 | 69 | 86 | 90 | 1.3 |
| 522683 | 24 | 33 | 65 | 77 | 88 | 1.8 |
| 522687 | 36 | 41 | 68 | 82 | 93 | 1.3 |
| 522690 | 23 | 51 | 67 | 84 | 93 | 1.5 |
| 522692 | 33 | 38 | 59 | 77 | 92 | 1.6 |
| 522705 | 35 | 48 | 66 | 73 | 86 | 1.3 |
| 522719 | 29 | 38 | 62 | 80 | 92 | 1.7 |
| 522757 | 29 | 41 | 60 | 79 | 93 | 1.6 |
| 522770 | 33 | 47 | 78 | 91 | 94 | 1.1 |
| 522784 | 20 | 33 | 54 | 71 | 90 | 2.2 |
| 522807 | 20 | 35 | 61 | 78 | 92 | 1.9 |

TABLE 111

| ISIS No | 0.625 μM | 1.25 μM | 2.50 μM | 5.00 μM | 10.00 μM | IC$_{50}$ (μM) |
|---|---|---|---|---|---|---|
| 413433 | 32 | 54 | 75 | 84 | 89 | 1.1 |
| 522758 | 26 | 49 | 66 | 87 | 94 | 1.4 |
| 522783 | 32 | 33 | 59 | 77 | 89 | 1.8 |
| 522838 | 16 | 39 | 64 | 75 | 82 | 2.0 |
| 522865 | 16 | 34 | 58 | 80 | 92 | 2.0 |
| 522866 | 16 | 25 | 45 | 66 | 83 | 2.8 |
| 522870 | 18 | 38 | 46 | 79 | 95 | 2.1 |
| 522871 | 13 | 35 | 57 | 80 | 91 | 2.1 |
| 522888 | 27 | 52 | 71 | 85 | 89 | 1.3 |
| 522889 | 36 | 59 | 75 | 81 | 80 | 0.9 |
| 522894 | 31 | 42 | 54 | 80 | 92 | 1.6 |
| 522897 | 29 | 53 | 76 | 88 | 92 | 1.2 |
| 522898 | 18 | 34 | 63 | 77 | 87 | 2.0 |
| 522913 | 40 | 54 | 79 | 90 | 90 | 0.9 |
| 522942 | 27 | 57 | 77 | 85 | 88 | 1.1 |

TABLE 112

| ISIS No | 0.625 μM | 1.25 μM | 2.50 μM | 5.00 μM | 10.00 μM | IC$_{50}$ (μM) |
|---|---|---|---|---|---|---|
| 413433 | 20 | 46 | 71 | 82 | 89 | 1.6 |
| 334177 | 9 | 30 | 60 | 74 | 92 | 2.3 |
| 522905 | 9 | 24 | 50 | 76 | 94 | 2.5 |
| 522917 | 17 | 35 | 58 | 82 | 93 | 2.0 |
| 522924 | 7 | 36 | 59 | 79 | 95 | 2.1 |
| 522925 | 15 | 36 | 64 | 85 | 95 | 1.8 |
| 522932 | 9 | 29 | 53 | 80 | 92 | 2.3 |
| 522941 | 23 | 44 | 65 | 85 | 91 | 1.6 |
| 522943 | 13 | 44 | 75 | 81 | 88 | 1.7 |
| 522947 | 45 | 30 | 62 | 78 | 94 | 1.4 |
| 522964 | 27 | 48 | 71 | 85 | 95 | 1.4 |
| 495876 | 24 | 33 | 58 | 86 | 94 | 1.8 |
| 495877 | 16 | 25 | 52 | 77 | 87 | 2.4 |
| 495878 | 37 | 69 | 86 | 91 | 96 | 0.7 |
| 523002 | 34 | 54 | 80 | 89 | 93 | 1.0 |

Example 9: Dose-Dependent Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. The antisense oligonucleotides were tested in a series of experiments that had similar culture conditions. The results for each experiment are presented in separate tables shown below. Cells were plated at a density of 20,000 cells per well and transfected using electroporation with 0.3125 μM, 0.625 μM, 1.25 μM, 2.50 μM, 5.00 μM, or 10.00 μM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 113

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 41 | 65 | 75 | 81 | 87 | 1.3 |
| 484157 | 24 | 52 | 78 | 87 | 95 | 94 | 0.6 |
| 484127 | 10 | 39 | 71 | 86 | 93 | 94 | 0.9 |
| 484181 | 49 | 57 | 76 | 79 | 89 | 90 | 0.3 |
| 484137 | 29 | 41 | 62 | 79 | 89 | 91 | 0.8 |
| 484148 | 0 | 30 | 72 | 77 | 91 | 93 | 1.2 |
| 484169 | 18 | 31 | 48 | 68 | 87 | 88 | 1.3 |
| 484170 | 0 | 51 | 58 | 75 | 94 | 90 | 1.3 |
| 484133 | 36 | 63 | 50 | 58 | 85 | 91 | 1.0 |
| 484140 | 31 | 60 | 65 | 73 | 87 | 92 | 0.6 |
| 484129 | 48 | 62 | 73 | 87 | 91 | 93 | 0.3 |
| 484141 | 40 | 33 | 55 | 64 | 85 | 96 | 0.9 |

TABLE 114

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 36 | 38 | 57 | 64 | 83 | 87 | 0.9 |
| 484158 | 8 | 6 | 39 | 61 | 86 | 91 | 1.9 |
| 484377 | 0 | 2 | 15 | 33 | 78 | 94 | 2.8 |
| 484130 | 18 | 41 | 51 | 79 | 91 | 96 | 1.0 |
| 484336 | 26 | 24 | 45 | 67 | 90 | 92 | 1.3 |
| 484167 | 0 | 0 | 33 | 72 | 89 | 96 | 2.3 |
| 484344 | 17 | 18 | 29 | 48 | 75 | 83 | 2.2 |
| 484156 | 0 | 5 | 29 | 47 | 76 | 81 | 2.9 |
| 484391 | 0 | 0 | 42 | 66 | 84 | 96 | 2.0 |
| 484353 | 0 | 16 | 48 | 72 | 91 | 99 | 1.6 |
| 484350 | 0 | 37 | 49 | 79 | 89 | 87 | 1.5 |
| 484357 | 15 | 23 | 39 | 69 | 91 | 94 | 1.5 |
| 484343 | 25 | 28 | 58 | 80 | 90 | 93 | 1.0 |

TABLE 115

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 34 | 34 | 65 | 83 | 86 | 85 | 0.8 |
| 472155 | 21 | 14 | 20 | 35 | 54 | 73 | 4.1 |
| 472156 | 11 | 23 | 41 | 42 | 66 | 84 | 2.3 |
| 472158 | 27 | 36 | 62 | 77 | 87 | 95 | 0.9 |
| 472175 | 4 | 25 | 30 | 60 | 69 | 89 | 2.1 |
| 472178 | 0 | 0 | 6 | 30 | 54 | 82 | 4.2 |
| 423453 | 32 | 31 | 57 | 77 | 90 | 94 | 0.9 |
| 380132 | 17 | 9 | 0 | 30 | 21 | 54 | >10 |
| 472433 | 0 | 0 | 0 | 0 | 18 | 62 | >10 |
| 217328 | 29 | 28 | 45 | 65 | 76 | 83 | 1.4 |

TABLE 116

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 36 | 55 | 70 | 81 | 92 | 93 | <0.6 |
| 501094 | 43 | 60 | 76 | 85 | 90 | 90 | <0.6 |
| 501097 | 23 | 39 | 56 | 74 | 81 | 82 | 1.1 |
| 501098 | 56 | 70 | 83 | 92 | 90 | 91 | <0.6 |
| 501100 | 51 | 62 | 82 | 91 | 92 | 90 | <0.6 |
| 501103 | 58 | 65 | 77 | 86 | 93 | 92 | <0.6 |
| 501118 | 26 | 50 | 54 | 72 | 85 | 88 | 0.9 |
| 501122 | 28 | 40 | 59 | 69 | 85 | 84 | 1.0 |
| 501127 | 38 | 61 | 75 | 81 | 89 | 88 | <0.6 |
| 501165 | 34 | 24 | 59 | 70 | 85 | 82 | 1.1 |
| 501171 | 38 | 57 | 64 | 80 | 88 | 89 | <0.6 |
| 501214 | 36 | 50 | 68 | 84 | 83 | 85 | <0.6 |

TABLE 117

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 17 | 38 | 61 | 84 | 88 | 91 | 1.0 |
| 500998 | 37 | 57 | 74 | 84 | 90 | 92 | 0.4 |
| 501020 | 29 | 53 | 73 | 83 | 89 | 92 | 0.6 |
| 501033 | 9 | 27 | 45 | 66 | 76 | 80 | 1.7 |
| 501034 | 14 | 42 | 56 | 75 | 83 | 90 | 1.1 |
| 501035 | 39 | 61 | 77 | 86 | 86 | 86 | 0.3 |
| 501040 | 17 | 25 | 40 | 71 | 86 | 91 | 1.4 |
| 501041 | 49 | 66 | 80 | 81 | 85 | 83 | <0.3 |
| 501062 | 24 | 29 | 50 | 66 | 81 | 88 | 1.3 |
| 501064 | 45 | 51 | 73 | 84 | 85 | 85 | 0.4 |
| 501093 | 12 | 34 | 55 | 72 | 76 | 78 | 1.4 |
| 501111 | 14 | 26 | 43 | 65 | 69 | 78 | 1.9 |

TABLE 118

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 41 | 47 | 65 | 81 | 91 | 94 | 0.6 |
| 500841 | 32 | 38 | 67 | 75 | 83 | 84 | 0.8 |
| 500844 | 35 | 51 | 77 | 74 | 77 | 63 | 0.4 |
| 500852 | 35 | 38 | 63 | 79 | 88 | 89 | 0.8 |
| 500859 | 58 | 39 | 52 | 85 | 91 | 96 | 0.5 |
| 500867 | 21 | 54 | 46 | 88 | 90 | 93 | 0.8 |
| 500913 | 42 | 65 | 58 | 89 | 91 | 90 | 0.4 |
| 500942 | 32 | 31 | 50 | 86 | 92 | 95 | 0.9 |
| 500966 | 53 | 75 | 78 | 84 | 88 | 89 | <0.3 |
| 500989 | 32 | 69 | 74 | 90 | 87 | 86 | 0.3 |
| 501018 | 13 | 58 | 72 | 86 | 87 | 82 | 0.7 |
| 501067 | 7 | 63 | 45 | 77 | 88 | 94 | 1.0 |

TABLE 119

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 39 | 44 | 70 | 77 | 92 | 1.7 |
| 501385 | 0 | 9 | 30 | 25 | 37 | 63 | 7.0 |
| 501387 | 0 | 0 | 0 | 14 | 27 | 75 | 6.8 |
| 501404 | 28 | 37 | 48 | 59 | 61 | 83 | 1.5 |
| 501412 | 0 | 23 | 24 | 16 | 51 | 75 | 4.6 |
| 501427 | 3 | 18 | 50 | 41 | 68 | 92 | 2.1 |
| 501430 | 21 | 7 | 47 | 53 | 74 | 90 | 1.9 |
| 501442 | 35 | 39 | 65 | 72 | 92 | 94 | 0.8 |
| 501443 | 36 | 50 | 34 | 48 | 62 | 75 | 1.6 |
| 501447 | 21 | 9 | 49 | 56 | 74 | 90 | 1.8 |
| 501448 | 23 | 25 | 48 | 60 | 69 | 88 | 1.6 |
| 501450 | 27 | 36 | 28 | 31 | 52 | 77 | 3.4 |

TABLE 120

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 13 | 31 | 51 | 80 | 86 | 2.1 |
| 501391 | 0 | 9 | 15 | 7 | 46 | 67 | 8.6 |
| 501393 | 0 | 0 | 0 | 50 | 64 | 81 | 3.1 |
| 501398 | 0 | 5 | 0 | 0 | 41 | 58 | >10 |
| 501405 | 0 | 31 | 33 | 57 | 73 | 80 | 2.0 |
| 501429 | 5 | 10 | 0 | 2 | 40 | 62 | >10 |
| 501435 | 20 | 15 | 34 | 50 | 79 | 89 | 1.9 |
| 501438 | 12 | 39 | 30 | 64 | 83 | 89 | 1.6 |
| 501440 | 42 | 21 | 41 | 57 | 81 | 92 | 1.3 |
| 501451 | 0 | 0 | 19 | 39 | 67 | 84 | 3.5 |
| 501452 | 0 | 7 | 14 | 38 | 54 | 85 | 3.6 |
| 501454 | 12 | 4 | 1 | 19 | 65 | 82 | 4.2 |

TABLE 121

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 26 | 56 | 75 | 82 | 92 | 1.2 |
| 501388 | 0 | 15 | 28 | 63 | 86 | 88 | 1.8 |
| 501389 | 0 | 0 | 0 | 58 | 69 | 84 | 2.1 |
| 501390 | 0 | 33 | 0 | 0 | 73 | 86 | 2.0 |
| 501392 | 0 | 19 | 57 | 60 | 75 | 81 | 2.2 |
| 501396 | 0 | 13 | 0 | 53 | 81 | 83 | 2.3 |
| 501411 | 0 | 0 | 0 | 31 | 45 | 78 | 5.5 |
| 501428 | 14 | 0 | 14 | 38 | 74 | 81 | 3.2 |
| 501436 | 0 | 0 | 41 | 61 | 80 | 78 | 2.2 |
| 501449 | 0 | 0 | 35 | 56 | 71 | 82 | 2.7 |
| 501455 | 0 | 0 | 19 | 30 | 61 | 75 | 4.1 |
| 501457 | 18 | 0 | 23 | 39 | 63 | 87 | 3.1 |

TABLE 122

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 19 | 33 | 46 | 69 | 80 | 91 | 1.3 |
| 501154 | 24 | 22 | 33 | 42 | 74 | 81 | 2.2 |
| 501183 | 18 | 42 | 54 | 71 | 71 | 80 | 1.2 |
| 501199 | 23 | 22 | 44 | 68 | 80 | 79 | 1.5 |
| 501200 | 8 | 13 | 40 | 65 | 78 | 87 | 1.9 |
| 501212 | 39 | 32 | 24 | 52 | 65 | 70 | 2.3 |
| 501213 | 12 | 34 | 40 | 69 | 75 | 79 | 1.6 |
| 501224 | 36 | 33 | 53 | 65 | 74 | 81 | 1.1 |
| 501270 | 12 | 9 | 42 | 59 | 67 | 76 | 2.3 |
| 501287 | 2 | 24 | 33 | 46 | 71 | 80 | 2.5 |
| 501322 | 8 | 9 | 6 | 31 | 54 | 77 | 4.4 |
| 501345 | 10 | 17 | 21 | 50 | 55 | 81 | 3.0 |

TABLE 123

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 11 | 17 | 33 | 60 | 69 | 4.2 |
| 525395 | 18 | 18 | 15 | 47 | 49 | 69 | 4.4 |
| 525401 | 10 | 28 | 33 | 58 | 68 | 68 | 2.5 |
| 525402 | 0 | 9 | 23 | 43 | 62 | 73 | 3.5 |
| 525414 | 2 | 11 | 29 | 36 | 56 | 56 | 5.2 |
| 525415 | 22 | 0 | 21 | 39 | 49 | 73 | 4.7 |
| 525431 | 6 | 19 | 36 | 49 | 67 | 66 | 2.9 |
| 525442 | 13 | 0 | 23 | 44 | 56 | 81 | 3.4 |
| 525443 | 4 | 6 | 24 | 61 | 65 | 78 | 2.7 |
| 525469 | 28 | 38 | 50 | 69 | 79 | 85 | 1.1 |
| 525470 | 3 | 17 | 23 | 41 | 70 | 82 | 2.8 |
| 525501 | 0 | 5 | 34 | 31 | 58 | 79 | 3.5 |

TABLE 124

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 22 | 35 | 48 | 62 | 76 | 86 | 1.4 |
| 525468 | 11 | 30 | 21 | 61 | 72 | 83 | 2.1 |
| 525471 | 29 | 47 | 62 | 70 | 77 | 84 | 0.8 |
| 525472 | 23 | 35 | 54 | 70 | 81 | 81 | 1.2 |
| 525474 | 22 | 38 | 54 | 69 | 79 | 78 | 1.2 |
| 525479 | 25 | 26 | 35 | 63 | 75 | 84 | 1.6 |
| 525480 | 0 | 21 | 29 | 50 | 75 | 75 | 2.7 |
| 525500 | 4 | 23 | 39 | 60 | 80 | 87 | 1.8 |
| 525513 | 32 | 21 | 45 | 55 | 77 | 86 | 1.6 |
| 525551 | 15 | 31 | 38 | 8 | 84 | 90 | 2.3 |
| 525552 | 11 | 29 | 49 | 56 | 78 | 87 | 1.6 |
| 525554 | 16 | 7 | 31 | 62 | 68 | 79 | 2.3 |

TABLE 125

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 28 | 21 | 44 | 50 | 68 | 79 | 1.9 |
| 525544 | 0 | 3 | 22 | 41 | 52 | 63 | 4.8 |
| 525612 | 26 | 36 | 56 | 72 | 76 | 79 | 1.1 |
| 525631 | 0 | 8 | 26 | 54 | 77 | 82 | 2.7 |
| 525649 | 0 | 0 | 10 | 46 | 64 | 76 | 3.7 |
| 496041 | 14 | 9 | 8 | 31 | 53 | 65 | 5.7 |
| 525688 | 5 | 25 | 43 | 68 | 82 | 89 | 1.6 |
| 525705 | 27 | 30 | 48 | 69 | 82 | 90 | 1.2 |
| 525708 | 5 | 26 | 54 | 69 | 84 | 89 | 1.5 |
| 525711 | 14 | 28 | 49 | 67 | 81 | 88 | 1.4 |
| 525733 | 21 | 42 | 60 | 76 | 82 | 93 | 1.0 |
| 525754 | 0 | 17 | 34 | 55 | 79 | 85 | 2.2 |

Example 10: Final Confirmation of Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. Cells were plated at a density of 20,000 cells per well and transfected using electroporation with 0.3125 μM, 0.625 μM, 1.25 μM, 2.50 μM, 5.00 μM, or 10.00 μM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 126

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 19 | 26 | 52 | 72 | 86 | 92 | 1.3 |
| 483817 | 18 | 31 | 60 | 74 | 86 | 90 | 1.1 |
| 483898 | 40 | 41 | 68 | 77 | 89 | 90 | 0.6 |
| 483908 | 21 | 47 | 63 | 83 | 89 | 92 | 0.8 |
| 484152 | 18 | 25 | 47 | 63 | 84 | 91 | 1.4 |
| 484181 | 42 | 45 | 73 | 81 | 87 | 86 | 0.5 |
| 484215 | 27 | 37 | 47 | 69 | 80 | 93 | 1.1 |
| 484231 | 16 | 33 | 58 | 71 | 83 | 89 | 1.2 |
| 472316 | 0 | 5 | 40 | 50 | 84 | 92 | 2.3 |
| 423463 | 17 | 34 | 55 | 80 | 90 | 93 | 1.1 |
| 484271 | 26 | 29 | 62 | 83 | 89 | 92 | 1.0 |
| 484283 | 7 | 12 | 30 | 50 | 79 | 90 | 2.2 |

TABLE 127

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 3 | 25 | 51 | 69 | 89 | 92 | 1.5 |
| 472158 | 18 | 25 | 26 | 44 | 71 | 80 | 2.4 |
| 483874 | 30 | 42 | 62 | 82 | 90 | 93 | 0.8 |
| 483910 | 20 | 30 | 49 | 74 | 85 | 90 | 1.2 |
| 483952 | 36 | 62 | 80 | 88 | 92 | 93 | 0.4 |

TABLE 127-continued

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 483968 | 8 | 35 | 57 | 73 | 86 | 91 | 1.2 |
| 483984 | 32 | 34 | 62 | 78 | 88 | 91 | 0.9 |
| 483987 | 12 | 10 | 36 | 61 | 80 | 92 | 1.9 |
| 483997 | 0 | 7 | 33 | 57 | 77 | 89 | 2.4 |
| 484085 | 25 | 24 | 53 | 72 | 87 | 89 | 1.2 |
| 484099 | 29 | 44 | 67 | 82 | 91 | 94 | 0.7 |
| 423453 | 19 | 24 | 46 | 62 | 88 | 95 | 1.4 |

TABLE 128

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 22 | 19 | 46 | 61 | 83 | 90 | 1.5 |
| 484127 | 16 | 18 | 54 | 74 | 90 | 95 | 1.3 |
| 484129 | 33 | 39 | 64 | 79 | 90 | 89 | 0.8 |
| 484130 | 30 | 29 | 52 | 66 | 85 | 92 | 1.1 |
| 484140 | 0 | 16 | 37 | 63 | 86 | 87 | 1.9 |
| 484133 | 1 | 2 | 44 | 71 | 83 | 93 | 1.8 |
| 484137 | 0 | 27 | 64 | 81 | 92 | 92 | 1.3 |
| 484148 | 16 | 37 | 67 | 79 | 91 | 94 | 1.0 |
| 484157 | 0 | 31 | 70 | 86 | 92 | 93 | 0.9 |
| 484170 | 23 | 40 | 57 | 77 | 90 | 94 | 1.0 |
| 484181 | 9 | 18 | 63 | 83 | 76 | 88 | 1.4 |
| 484343 | 18 | 21 | 40 | 72 | 88 | 91 | 1.4 |

TABLE 129

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 23 | 30 | 57 | 71 | 83 | 2.4 |
| 501849 | 22 | 33 | 46 | 65 | 79 | 87 | 1.4 |
| 501850 | 12 | 19 | 40 | 52 | 76 | 83 | 2.0 |
| 501852 | 17 | 25 | 47 | 63 | 68 | 77 | 1.8 |
| 501855 | 24 | 37 | 59 | 78 | 82 | 84 | 1.0 |
| 501861 | 15 | 23 | 45 | 61 | 77 | 84 | 1.7 |
| 501871 | 14 | 19 | 39 | 57 | 71 | 85 | 2.0 |
| 501884 | 14 | 25 | 42 | 57 | 74 | 83 | 1.9 |
| 501886 | 30 | 40 | 47 | 58 | 70 | 73 | 1.4 |
| 501932 | 8 | 24 | 28 | 55 | 68 | 78 | 2.4 |
| 501944 | 6 | 31 | 0 | 44 | 67 | 82 | 3.3 |
| 501950 | 0 | 14 | 19 | 55 | 79 | 85 | 2.4 |

TABLE 130

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 31 | 43 | 53 | 74 | 80 | 84 | 0.9 |
| 502154 | 29 | 46 | 68 | 81 | 86 | 91 | 0.7 |
| 502163 | 22 | 33 | 55 | 71 | 89 | 97 | 1.1 |
| 502164 | 20 | 32 | 71 | 72 | 85 | 91 | 1.0 |
| 502179 | 28 | 50 | 67 | 84 | 81 | 90 | 0.7 |
| 502191 | 29 | 47 | 64 | 74 | 94 | 97 | 0.7 |
| 502194 | 24 | 23 | 62 | 78 | 90 | 90 | 1.1 |
| 502314 | 25 | 14 | 21 | 44 | 66 | 85 | 2.6 |
| 502319 | 20 | 32 | 56 | 78 | 86 | 92 | 1.1 |
| 502322 | 17 | 35 | 49 | 68 | 79 | 83 | 1.4 |
| 502331 | 11 | 22 | 11 | 45 | 60 | 82 | 3.1 |
| 502334 | 35 | 40 | 59 | 69 | 82 | 92 | 0.8 |

TABLE 131

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 13 | 16 | 25 | 38 | 59 | 75 | 3.5 |
| 495702 | 29 | 37 | 49 | 65 | 78 | 80 | 1.2 |
| 495718 | 21 | 34 | 28 | 56 | 71 | 77 | 2.0 |
| 495756 | 23 | 40 | 56 | 76 | 87 | 95 | 1.0 |
| 507692 | 20 | 33 | 56 | 68 | 89 | 91 | 1.1 |
| 507693 | 28 | 38 | 56 | 79 | 89 | 94 | 0.9 |
| 507694 | 19 | 30 | 45 | 72 | 87 | 94 | 1.3 |
| 507695 | 28 | 32 | 44 | 70 | 84 | 92 | 1.2 |
| 507696 | 18 | 37 | 59 | 78 | 88 | 90 | 1.0 |
| 507710 | 27 | 39 | 52 | 73 | 91 | 92 | 1.0 |
| 507716 | 32 | 51 | 52 | 68 | 88 | 93 | 0.8 |
| 507717 | 31 | 49 | 44 | 66 | 84 | 90 | 1.0 |

TABLE 132

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 43 | 64 | 80 | 84 | 90 | 1.2 |
| 501947 | 7 | 23 | 42 | 65 | 79 | 89 | 1.7 |
| 501951 | 13 | 25 | 45 | 68 | 85 | 92 | 1.5 |
| 501959 | 8 | 29 | 38 | 66 | 74 | 90 | 1.7 |
| 501960 | 14 | 22 | 41 | 68 | 75 | 88 | 1.7 |
| 501968 | 17 | 33 | 44 | 59 | 88 | 87 | 1.4 |
| 502038 | 0 | 7 | 8 | 36 | 58 | 84 | 3.7 |
| 502045 | 13 | 38 | 53 | 67 | 81 | 88 | 1.3 |
| 502056 | 0 | 31 | 66 | 83 | 88 | 91 | 1.2 |
| 502098 | 9 | 35 | 48 | 72 | 86 | 93 | 1.3 |
| 502099 | 9 | 31 | 52 | 74 | 82 | 92 | 1.3 |
| 502119 | 1 | 45 | 61 | 79 | 89 | 95 | 1.1 |

TABLE 133

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 0 | 43 | 59 | 69 | 84 | 90 | 1.1 |
| 495697 | 15 | 32 | 50 | 66 | 78 | 79 | 1.5 |
| 495705 | 25 | 37 | 53 | 59 | 76 | 79 | 1.3 |
| 495719 | 21 | 30 | 44 | 64 | 76 | 84 | 1.5 |
| 501388 | 13 | 34 | 44 | 62 | 71 | 87 | 1.6 |
| 501389 | 11 | 44 | 47 | 54 | 80 | 91 | 1.4 |
| 501392 | 0 | 25 | 42 | 51 | 75 | 87 | 1.9 |
| 501396 | 19 | 31 | 52 | 66 | 76 | 87 | 1.4 |
| 501428 | 0 | 0 | 33 | 46 | 63 | 85 | 2.8 |
| 501436 | 4 | 28 | 23 | 57 | 76 | 88 | 2.1 |
| 501449 | 19 | 21 | 42 | 59 | 75 | 92 | 1.7 |
| 501457 | 7 | 29 | 35 | 50 | 75 | 92 | 1.9 |

TABLE 134

| ISIS No | 0.3125 μM | 0.625 μM | 1.25 μM | 2.50 μM | 5.00 μM | 10.00 μM | IC$_{50}$ (μM) |
|---|---|---|---|---|---|---|---|
| 413433 | 13 | 35 | 53 | 73 | 83 | 87 | 1.3 |
| 522373 | 19 | 34 | 54 | 72 | 83 | 84 | 1.2 |
| 522374 | 13 | 31 | 54 | 65 | 79 | 85 | 1.4 |
| 522383 | 23 | 44 | 62 | 72 | 76 | 81 | 1.0 |
| 522435 | 25 | 39 | 55 | 73 | 81 | 80 | 1.1 |
| 522437 | 26 | 35 | 56 | 70 | 81 | 85 | 1.1 |
| 522440 | 14 | 33 | 50 | 67 | 77 | 82 | 1.5 |
| 522444 | 24 | 35 | 57 | 78 | 83 | 89 | 1.0 |
| 522445 | 25 | 45 | 57 | 69 | 83 | 86 | 1.0 |
| 522465 | 14 | 15 | 40 | 55 | 75 | 82 | 2.0 |
| 522484 | 37 | 0 | 72 | 75 | 76 | 74 | 1.3 |
| 522501 | 25 | 45 | 55 | 72 | 78 | 76 | 1.0 |

TABLE 135

| ISIS No | 0.3125 µM | 0.625 µM | 1.25 µM | 2.50 µM | 5.00 µM | 10.00 µM | IC$_{50}$ (µM) |
|---|---|---|---|---|---|---|---|
| 413433 | 25 | 36 | 50 | 79 | 83 | 87 | 1.1 |
| 522580 | 27 | 34 | 55 | 62 | 86 | 85 | 1.1 |
| 522587 | 35 | 40 | 56 | 73 | 88 | 92 | 0.8 |
| 522589 | 27 | 40 | 56 | 71 | 82 | 91 | 1.0 |
| 522609 | 37 | 48 | 70 | 82 | 94 | 93 | 0.5 |
| 522621 | 20 | 35 | 55 | 74 | 86 | 91 | 1.1 |
| 522632 | 31 | 52 | 66 | 80 | 90 | 93 | 0.6 |
| 522643 | 16 | 28 | 48 | 67 | 78 | 87 | 1.5 |
| 522688 | 16 | 38 | 57 | 75 | 76 | 89 | 1.2 |
| 522689 | 29 | 34 | 58 | 78 | 84 | 91 | 0.9 |
| 522717 | 18 | 24 | 50 | 72 | 82 | 88 | 1.4 |
| 522745 | 22 | 35 | 57 | 75 | 89 | 92 | 1.0 |

TABLE 136

| ISIS No | 0.3125 µM | 0.625 µM | 1.25 µM | 2.50 µM | 5.00 µM | 10.00 µM | IC$_{50}$ (µM) |
|---|---|---|---|---|---|---|---|
| 413433 | 23 | 32 | 45 | 74 | 78 | 88 | 1.3 |
| 522682 | 26 | 34 | 63 | 68 | 74 | 81 | 1.1 |
| 522770 | 8 | 26 | 50 | 65 | 83 | 91 | 1.5 |
| 522889 | 25 | 40 | 59 | 70 | 77 | 78 | 1.1 |
| 522897 | 14 | 22 | 45 | 69 | 83 | 89 | 1.5 |
| 522913 | 19 | 30 | 57 | 73 | 86 | 90 | 1.2 |
| 522941 | 8 | 18 | 41 | 56 | 73 | 82 | 2.1 |
| 522942 | 20 | 30 | 49 | 67 | 83 | 86 | 1.3 |
| 522947 | 14 | 0 | 40 | 58 | 80 | 91 | 2.0 |
| 522964 | 9 | 20 | 51 | 63 | 78 | 89 | 1.7 |
| 495878 | 16 | 36 | 62 | 80 | 90 | 93 | 1.0 |
| 523002 | 21 | 32 | 51 | 67 | 73 | 84 | 1.4 |

TABLE 137

| ISIS No | 0.3125 µM | 0.625 µM | 1.25 µM | 2.50 µM | 5.00 µM | 10.00 µM | IC$_{50}$ (µM) |
|---|---|---|---|---|---|---|---|
| 413433 | 40 | 35 | 66 | 81 | 87 | 89 | 0.7 |
| 525401 | 17 | 58 | 64 | 79 | 85 | 86 | 0.8 |
| 525402 | 30 | 41 | 49 | 74 | 87 | 90 | 0.9 |
| 525431 | 31 | 29 | 64 | 82 | 86 | 84 | 0.9 |
| 525442 | 35 | 39 | 59 | 76 | 90 | 87 | 0.8 |
| 525443 | 39 | 53 | 64 | 76 | 88 | 89 | 0.5 |
| 525469 | 32 | 68 | 85 | 93 | 92 | 93 | 0.3 |
| 525470 | 39 | 34 | 59 | 74 | 91 | 89 | 0.8 |
| 525471 | 27 | 34 | 59 | 84 | 86 | 0 | 0.9 |
| 525474 | 32 | 47 | 69 | 80 | 93 | 87 | 0.6 |
| 525479 | 25 | 33 | 51 | 60 | 75 | 75 | 1.5 |
| 525501 | 31 | 29 | 56 | 82 | 91 | 88 | 1.0 |

TABLE 138

| ISIS No | 0.3125 µM | 0.625 µM | 1.25 µM | 2.50 µM | 5.00 µM | 10.00 µM | IC$_{50}$ (µM) |
|---|---|---|---|---|---|---|---|
| 413433 | 22 | 41 | 54 | 69 | 81 | 88 | 1.1 |
| 525472 | 26 | 31 | 50 | 69 | 84 | 82 | 1.2 |
| 525500 | 11 | 33 | 52 | 68 | 83 | 83 | 1.4 |
| 525513 | 16 | 20 | 48 | 64 | 79 | 87 | 1.6 |
| 525552 | 27 | 30 | 57 | 70 | 83 | 90 | 1.1 |
| 525612 | 0 | 44 | 65 | 76 | 83 | 82 | 0.3 |
| 525688 | 11 | 40 | 60 | 75 | 88 | 97 | 1.1 |
| 525705 | 25 | 41 | 65 | 76 | 90 | 95 | 0.8 |
| 525708 | 36 | 38 | 64 | 75 | 93 | 96 | 0.7 |
| 525711 | 24 | 53 | 67 | 80 | 90 | 94 | 0.7 |
| 525733 | 27 | 70 | 73 | 86 | 91 | 95 | 0.4 |
| 525754 | 23 | 23 | 48 | 70 | 85 | 89 | 1.3 |

Example 11: Final Confirmation of Antisense Inhibition of Human DGAT2 in HepG2 Cells by MOE Gapmers Gapmers from the studies described in the Examples above exhibiting significant in vitro inhibition of DGAT2 mRNA were selected and tested at various doses in HepG2 cells. Cells were plated at a density of 20,000 cells per well and transfected using electroporation with 0.625 µM, 1.25 µM, 2.50 µM, 5.00 µM, or 10.00 µM concentrations of antisense oligonucleotide, as specified in the Tables below. After a treatment period of approximately 16 hours, RNA was isolated from the cells and DGAT2 mRNA levels were measured by quantitative real-time PCR. Human primer probe set RTS2988_MGB was used to measure mRNA levels. DGAT2 mRNA levels were adjusted according to total RNA content, as measured by RIBOGREEN®. Results are presented as percent inhibition of DGAT2, relative to untreated control cells. '0' indicates that the mRNA levels were not inhibited.

The half maximal inhibitory concentration (IC$_{50}$) of each oligonucleotide is also presented. DGAT2 mRNA levels were significantly reduced in a dose-dependent manner in antisense oligonucleotide treated cells.

TABLE 139

| ISIS No | 0.625 µM | 1.25 µM | 2.50 µM | 5.00 µM | 10.00 µM | IC$_{50}$ (µM) |
|---|---|---|---|---|---|---|
| 413433 | 48 | 60 | 77 | 85 | 86 | 0.6 |
| 495450 | 42 | 50 | 73 | 83 | 83 | 1.0 |
| 495516 | 64 | 78 | 87 | 84 | 84 | <0.6 |
| 495520 | 70 | 76 | 87 | 83 | 82 | <0.6 |
| 495554 | 26 | 61 | 75 | 76 | 85 | 1.1 |
| 495555 | 30 | 72 | 80 | 87 | 84 | 0.8 |
| 495576 | 61 | 73 | 86 | 88 | 88 | <0.6 |
| 495577 | 44 | 64 | 75 | 85 | 80 | 0.6 |
| 495609 | 64 | 69 | 83 | 86 | 89 | <0.6 |
| 495685 | 0 | 53 | 75 | 82 | 85 | 2.0 |
| 495707 | 9 | 41 | 72 | 75 | 66 | 2.2 |
| 495736 | 16 | 61 | 80 | 85 | 81 | 1.3 |
| 495749 | 16 | 33 | 76 | 90 | 93 | 1.7 |
| 495752 | 0 | 66 | 75 | 74 | 93 | 1.7 |
| 495753 | 0 | 59 | 79 | 91 | 92 | 1.8 |

TABLE 140

| ISIS No | 0.625 µM | 1.25 µM | 2.50 µM | 5.00 µM | 10.00 µM | IC$_{50}$ (µM) |
|---|---|---|---|---|---|---|
| 413433 | 54 | 70 | 87 | 91 | 93 | <0.6 |
| 495738 | 55 | 57 | 81 | 92 | 92 | <0.6 |
| 495744 | 37 | 59 | 78 | 88 | 90 | 0.9 |
| 495756 | 52 | 61 | 80 | 90 | 94 | <0.6 |
| 495825 | 34 | 69 | 89 | 94 | 97 | 0.7 |
| 495829 | 38 | 79 | 88 | 90 | 91 | <0.6 |
| 495837 | 52 | 67 | 93 | 93 | 96 | <0.6 |
| 495839 | 66 | 89 | 91 | 93 | 93 | <0.6 |
| 495840 | 64 | 84 | 94 | 96 | 94 | <0.6 |
| 495841 | 51 | 82 | 90 | 92 | 93 | <0.6 |
| 495842 | 54 | 73 | 88 | 90 | 92 | <0.6 |
| 495849 | 63 | 69 | 82 | 85 | 91 | <0.6 |
| 495853 | 72 | 77 | 91 | 96 | 94 | <0.6 |
| 495857 | 52 | 61 | 88 | 91 | 92 | <0.6 |
| 495878 | 54 | 77 | 93 | 97 | 96 | <0.6 |

TABLE 141

| ISIS No | 0.625 µM | 1.25 µM | 2.50 µM | 5.00 µM | 10.00 µM | IC$_{50}$ (µM) |
|---|---|---|---|---|---|---|
| 413433 | 38 | 63 | 73 | 85 | 88 | 0.8 |
| 501171 | 38 | 53 | 69 | 83 | 84 | 1.0 |
| 501183 | 51 | 70 | 79 | 87 | 89 | <0.6 |
| 501199 | 44 | 68 | 88 | 91 | 87 | <0.6 |
| 501213 | 25 | 57 | 82 | 93 | 96 | 1.1 |
| 501214 | 35 | 56 | 72 | 88 | 92 | 1.0 |
| 501224 | 48 | 68 | 83 | 90 | 90 | <0.6 |
| 501405 | 27 | 51 | 72 | 90 | 96 | 1.3 |
| 501430 | 10 | 26 | 65 | 90 | 94 | 2.0 |
| 501435 | 35 | 41 | 71 | 92 | 94 | 1.3 |
| 501438 | 27 | 71 | 83 | 92 | 92 | 0.9 |
| 501440 | 24 | 40 | 66 | 90 | 97 | 1.6 |
| 501442 | 58 | 79 | 91 | 96 | 94 | <0.6 |
| 501443 | 32 | 29 | 57 | 89 | 96 | 1.7 |
| 501448 | 27 | 46 | 72 | 91 | 93 | 1.4 |

TABLE 142

| ISIS No | 0.625 µM | 1.25 µM | 2.50 µM | 5.00 µM | 10.00 µM | IC$_{50}$ (µM) |
|---|---|---|---|---|---|---|
| 413433 | 43 | 58 | 82 | 91 | 94 | 0.8 |
| 501127 | 46 | 68 | 81 | 91 | 92 | <0.6 |
| 501103 | 34 | 70 | 85 | 93 | 91 | 0.7 |
| 501100 | 54 | 75 | 88 | 93 | 94 | <0.6 |
| 501098 | 55 | 81 | 91 | 91 | 89 | <0.6 |
| 501094 | 62 | 70 | 87 | 90 | 92 | <0.6 |
| 501064 | 52 | 67 | 81 | 88 | 89 | <0.6 |
| 501041 | 53 | 71 | 82 | 86 | 85 | <0.6 |
| 501035 | 57 | 77 | 87 | 88 | 90 | <0.6 |
| 501020 | 47 | 63 | 86 | 94 | 94 | 0.6 |
| 500998 | 47 | 61 | 86 | 91 | 95 | 0.6 |
| 500989 | 55 | 75 | 83 | 86 | 85 | <0.6 |
| 500966 | 71 | 82 | 85 | 87 | 87 | <0.6 |
| 500913 | 29 | 46 | 74 | 85 | 88 | 1.3 |
| 500859 | 6 | 44 | 75 | 87 | 90 | 1.8 |

Example 12: Tolerability of Antisense Oligonucleotides Targeting Human DGAT2 in CD1 Mice CD1® mice (Charles River, Mass.) are a multipurpose mice model, frequently utilized for safety and efficacy testing. The mice were treated with ISIS antisense oligonucleotides selected from studies described above and evaluated for changes in the levels of various plasma chemistry markers. Liver and kidney tissue from the treated mice were microscopically reviewed; no toxicity or tissue injury was seen in any treated animal.

Treatment

Groups of five male CD1 mice each were injected subcutaneously twice a week for 6 weeks with 100 mg/kg (200 mg/kg/week) of ISIS oligonucleotide. One group of ten male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, albumin, and BUN were measured on day 27 using an automated clinical chemistry analyzer (Hitachi Olympus AU400e, Melville, N.Y.). The results are presented in the Table below. ISIS oligonucleotides that caused changes in the levels of any of the liver or kidney function markers outside the expected range for antisense oligonucleotides were excluded in further studies.

TABLE 143

Plasma chemistry markers in CD1 mice

| | ALT (IU/L) | AST (IU/L) | BUN (mg/dL) | Bilirubin (mg/dL) |
|---|---|---|---|---|
| PBS | 33 | 50 | 30 | 0.3 |
| ISIS 483984 | 193 | 177 | 30 | 0.3 |
| ISIS 484099 | 69 | 77 | 23 | 0.2 |
| ISIS 484129 | 43 | 46 | 24 | 0.2 |
| ISIS 484157 | 136 | 105 | 26 | 0.2 |
| ISIS 495576 | 36 | 53 | 30 | 0.3 |
| ISIS 495609 | 102 | 112 | 28 | 0.3 |
| ISIS 495753 | 68 | 76 | 28 | 0.2 |
| ISIS 495756 | 154 | 123 | 26 | 0.3 |
| ISIS 501849 | 45 | 58 | 26 | 0.2 |
| ISIS 501850 | 294 | 306 | 26 | 0.3 |
| ISIS 501855 | 62 | 56 | 28 | 0.2 |
| ISIS 501861 | 100 | 97 | 30 | 0.3 |
| ISIS 502322 | 42 | 46 | 28 | 0.2 |
| ISIS 507696 | 99 | 132 | 30 | 0.2 |
| ISIS 507710 | 50 | 68 | 27 | 0.3 |
| ISIS 507716 | 3112 | 3302 | 19 | 7.8 |

Body and Organ Weights

Body weights of the mice were measured on day 35 and are presented in the Table below. Liver, spleen and kidney weights were measured at the end of the study (day 41), and are also presented in the Table below. ISIS oligonucleotides that caused any changes in body or organ weights outside the expected range for antisense oligonucleotides were excluded from further studies. 'n/a' indicates that the particular endpoint was not measured in that group of mice.

TABLE 144

Body and organ weights of CD1 mice (g)

| | Body weight | Kidney | Liver | Spleen |
|---|---|---|---|---|
| PBS | 41.2 | 0.7 | 2.0 | 0.1 |
| ISIS 483984 | 41.0 | n/a | n/a | n/a |
| ISIS 484129 | 41.0 | 0.6 | 2.1 | 0.2 |
| ISIS 484157 | 38.8 | n/a | n/a | n/a |
| ISIS 495576 | 41.4 | 0.6 | 2.1 | 0.2 |
| ISIS 495609 | 42.5 | 0.6 | 2.1 | 0.2 |
| ISIS 495753 | 40.0 | 0.5 | 2.2 | 0.2 |
| ISIS 495756 | 42.0 | 0.7 | 2.6 | 0.2 |
| ISIS 501849 | 42.3 | 0.6 | 2.4 | 0.2 |
| ISIS 501850 | 41.7 | 0.7 | 2.5 | 0.2 |
| ISIS 501855 | 39.9 | n/a | n/a | n/a |
| ISIS 501861 | 40.3 | 0.6 | 2.3 | 0.2 |
| ISIS 502322 | 41.1 | 0.7 | 2.2 | 0.2 |
| ISIS 507696 | 38.9 | 0.6 | 2.3 | 0.2 |
| ISIS 507710 | 42.7 | 0.6 | 2.5 | 0.2 |

Example 13: Tolerability of Antisense Oligonucleotides Targeting Human DGAT2 in CD1 Mice CD1® mice were treated with ISIS antisense oligonucleotides selected from studies described above and evaluated for changes in the levels of various plasma chemistry markers.

Treatment

Groups of five male CD1 mice each were injected subcutaneously twice a week for 6 weeks with 50 mg/kg of ISIS 483817, ISIS 483910, ISIS 484085, ISIS 484127, ISIS 484130, ISIS 484137, ISIS 484215, ISIS 484231, ISIS 484271, ISIS 501871, ISIS 502098, ISIS 502119, ISIS 502154, ISIS 502163, ISIS 502164, ISIS 502194, ISIS 525443, ISIS 525474, ISIS 525552, ISIS 525612, ISIS 525688, ISIS 525705, ISIS 525708, ISIS 525711, and ISIS 525733. One group of ten male CD1 mice was injected subcutaneously twice a week for 6 weeks with PBS. Mice were euthanized 48 hours after the last dose, and organs and plasma were harvested for further analysis.

Plasma Chemistry Markers

To evaluate the effect of ISIS oligonucleotides on liver and kidney function, plasma levels of transaminases, bilirubin, albumin, and BUN were measured on day 26 using an automated clinical chemistry analyzer (Hitachi Olympus AU400e, Melville, N.Y.). The results are presented in the Table below. ISIS oligonucleotides that caused changes in the levels of any of the liver or kidney function markers outside the expected range for antisense oligonucleotides were excluded in further studies.

TABLE 145

Plasma chemistry markers in CD1 mice

|  | ALT (IU/L) | AST (IU/L) | BUN (mg/dL) | Bilirubin (mg/dL) |
| --- | --- | --- | --- | --- |
| PBS | 26 | 55 | 29 | 0.6 |
| ISIS 483817 | 40 | 54 | 27 | 0.3 |
| ISIS 483910 | 244 | 155 | 28 | 0.6 |
| ISIS 484085 | 46 | 58 | 27 | 0.4 |
| ISIS 484127 | 100 | 147 | 25 | 0.4 |
| ISIS 484130 | 151 | 91 | 29 | 0.3 |
| ISIS 484137 | 31 | 49 | 26 | 0.3 |
| ISIS 484215 | 42 | 49 | 25 | 0.2 |
| ISIS 484231 | 31 | 45 | 26 | 0.2 |
| ISIS 484271 | 2847 | 3267 | 26 | 2.9 |
| ISIS 501871 | 108 | 96 | 23 | 0.2 |
| ISIS 502098 | 60 | 62 | 24 | 0.3 |
| ISIS 502119 | 402 | 370 | 26 | 0.3 |
| ISIS 502154 | 293 | 294 | 28 | 0.3 |
| ISIS 502163 | 45 | 60 | 23 | 0.4 |
| ISIS 502164 | 81 | 75 | 25 | 0.4 |
| ISIS 502194 | 32 | 43 | 24 | 0.4 |
| ISIS 525443 | 93 | 101 | 24 | 0.3 |
| ISIS 525474 | 49 | 94 | 24 | 0.6 |
| ISIS 525552 | 1374 | 874 | 25 | 0.3 |
| ISIS 525612 | 78 | 54 | 27 | 0.4 |
| ISIS 525705 | 76 | 117 | 31 | 0.3 |
| ISIS 525708 | 59 | 79 | 29 | 0.3 |
| ISIS 525711 | 1670 | 787 | 26 | 0.3 |

Body and Organ Weights

Body weights of the mice were measured on day 36 and are presented in the Table below. Liver, spleen and kidney weights were measured at the end of the study, and are also presented in the Table below. ISIS oligonucleotides that caused any changes in body or organ weights outside the expected range for antisense oligonucleotides were excluded from further studies. 'n/a' indicates that the particular endpoint was not measured in that group of mice.

TABLE 146

Body and organ weights of CD1 mice (g)

|  | Body weight | Kidney | Liver | Spleen |
| --- | --- | --- | --- | --- |
| PBS | 39.4 | 0.7 | 2.0 | 0.1 |
| ISIS 483817 | 38.8 | 0.6 | 2.3 | 0.2 |
| ISIS 483910 | 39.2 | 0.6 | 2.3 | 0.2 |
| ISIS 484085 | 37.9 | 0.6 | 2.3 | 0.1 |
| ISIS 484127 | 35.3 | n/a | n/a | n/a |
| ISIS 484130 | 41.5 | n/a | n/a | n/a |
| ISIS 484137 | 39.6 | 0.7 | 2.3 | 0.1 |
| ISIS 484215 | 38.5 | 0.6 | 2.4 | 0.2 |
| ISIS 484231 | 38.3 | 0.6 | 2.1 | 0.1 |
| ISIS 501871 | 38.7 | 0.6 | 2.3 | 0.2 |
| ISIS 502098 | 38.8 | 0.6 | 2.5 | 0.2 |
| ISIS 502163 | 39.1 | 0.6 | 2.0 | 0.2 |
| ISIS 502164 | 37.7 | 0.6 | 2.1 | 0.2 |
| ISIS 502194 | 40.5 | 0.6 | 1.9 | 0.1 |
| ISIS 525443 | 39.5 | 0.6 | 2.0 | 0.2 |
| ISIS 525474 | 37.0 | 0.6 | 1.8 | 0.1 |
| ISIS 525612 | 37.8 | 0.6 | 2.0 | 0.1 |
| ISIS 525705 | 36.5 | 0.7 | 2.0 | 0.4 |
| ISIS 525708 | 38.7 | 0.7 | 2.0 | 0.3 |

Example 14: Tolerability of Antisense Oligonucleotides Targeting Human DGAT2 in Sprague-Dawley Rats Sprague-Dawley rats are a multipurpose model used for safety and efficacy evaluations. The rats were treated with ISIS antisense oligonucleotides from the study described above and evaluated for changes in the levels of various plasma chemistry markers.

Treatment

Male Sprague-Dawley rats were maintained on a 12-hour light/dark cycle and fed ad libitum with Purina normal rat chow, diet 5001. Groups of 4 Sprague-Dawley rats each were injected subcutaneously twice a week for 8 weeks with 50 mg/kg of ISIS 484129, ISIS 495576, ISIS 495609, ISIS 495753, ISIS 495756, ISIS 501849, ISIS 501850, ISIS 501861, ISIS 502322, ISIS 507696, and ISIS 507710. Forty eight hours after the last dose, rats were euthanized and organs and plasma were harvested for further analysis.

Liver Function

To evaluate the effect of ISIS oligonucleotides on hepatic function, plasma levels of transaminases were measured on day 56 using an automated clinical chemistry analyzer (Hitachi Olympus AU400e, Melville, N.Y.). Plasma levels of ALT and AST were measured and the results are presented in the Table below expressed in IU/L. Plasma levels of Bilirubin were also measured using the same clinical chemistry analyzer and the results are also presented in the Table below. ISIS oligonucleotides that caused changes in the levels of any markers of liver function outside the expected range for antisense oligonucleotides were excluded in further studies.

TABLE 147

Liver function markers in Sprague-Dawley rats

|  | ALT (IU/L) | AST (IU/L) | Bilirubin (mg/dL) |
| --- | --- | --- | --- |
| PBS | 49 | 70 | 0.16 |
| ISIS 484129 | 133 | 130 | 0.18 |
| ISIS 495576 | 99 | 148 | 0.17 |
| ISIS 495609 | 406 | 269 | 0.32 |
| ISIS 495753 | 968 | 1258 | 1.83 |
| ISIS 495756 | 165 | 206 | 0.24 |
| ISIS 501849 | 57 | 103 | 0.16 |
| ISIS 501850 | 1218 | 1916 | 6.55 |
| ISIS 501861 | 61 | 113 | 0.14 |
| ISIS 502322 | 79 | 84 | 0.14 |

Kidney Function

To evaluate the effect of ISIS oligonucleotides on kidney function, urine levels of creatinine and total protein were measured on day 56 using an automated clinical chemistry analyzer (Hitachi Olympus AU400e, Melville, N.Y.). Results are presented in the Table below, expressed in mg/dL.

TABLE 148

Kidney function markers (mg/dL) in Sprague-Dawley rats

|  | Creatinine | Total protein |
|---|---|---|
| PBS | 146 | 114 |
| ISIS 495756 | 63 | 978 |
| ISIS 501849 | 82 | 445 |
| ISIS 501861 | 67 | 309 |
| ISIS 501850 | 52 | 268 |
| ISIS 502322 | 84 | 507 |
| ISIS 495576 | 108 | 587 |
| ISIS 495609 | 38 | 264 |
| ISIS 495753 | 73 | 411 |
| ISIS 484129 | 66 | 312 |

Body and Organ Weights

Body weights of the rat were measured on day 50 and are presented in the Table below. Liver, heart, spleen and kidney weights were measured at the end of the study, and are also presented in the Table below. ISIS oligonucleotides that caused any changes in body or organ weights outside the expected range for antisense oligonucleotides were excluded from further studies. 'n/a' indicates that the particular endpoint was not measured in that group of mice.

TABLE 149

Body and organ weights of Sprague-Dawley rats (g)

|  | Body weight | Heart | Kidney | Liver | Spleen |
|---|---|---|---|---|---|
| PBS | 486 | 1.7 | 3.5 | 14.2 | 0.7 |
| ISIS 495756 | 374 | 1.1 | 3.5 | 15.5 | 2.2 |
| ISIS 501849 | 404 | 1.2 | 3.3 | 13.7 | 1.9 |
| ISIS 501861 | 390 | 1.1 | 3.6 | 16.0 | 2.7 |
| ISIS 501850 | 329 | 1.3 | 4.1 | 16.3 | 4.5 |
| ISIS 502322 | 424 | 1.3 | 3.4 | 15.6 | 1.7 |
| ISIS 495576 | 461 | 1.3 | 3.5 | 17.3 | 2.1 |
| ISIS 495609 | 383 | 1.4 | 3.8 | 18.9 | 3.8 |
| ISIS 495753 | 384 | 1.2 | 3.4 | 16.3 | 3.6 |
| ISIS 484129 | 415 | 1.3 | 3.1 | 14.9 | 1.5 |

Example 15: Tolerability of Antisense Oligonucleotides Targeting Human DGAT2 in Sprague-Dawley Rats Sprague-Dawley rats were treated with ISIS antisense oligonucleotides from the studies described above and evaluated for changes in the levels of various plasma chemistry markers.

Treatment

Male Sprague-Dawley rats were maintained on a 12-hour light/dark cycle and fed ad libitum with Purina normal rat chow, diet 5001. Groups of 4 Sprague-Dawley rats each were injected subcutaneously twice a week for 8 weeks with 50 mg/kg of ISIS 483817, ISIS 483910, ISIS 484085, ISIS 484137, ISIS 484215, ISIS 484231, ISIS 501871, ISIS 502098, ISIS 502163, ISIS 502164, ISIS 502194, ISIS 525443, ISIS 525474, ISIS 525612, and ISIS 525708. Forty eight hours after the last dose, rats were euthanized and organs and plasma were harvested for further analysis.

Liver Function

To evaluate the effect of ISIS oligonucleotides on hepatic function, plasma levels of transaminases were measured on day 53 using an automated clinical chemistry analyzer (Hitachi Olympus AU400e, Melville, N.Y.). Plasma levels of ALT and AST were measured and the results are presented in the Table below expressed in IU/L. Plasma levels of Bilirubin were also measured using the same clinical chemistry analyzer and the results are also presented in the Table below. ISIS oligonucleotides that caused changes in the levels of any markers of liver function outside the expected range for antisense oligonucleotides were excluded in further studies.

TABLE 150

Liver function markers in Sprague-Dawley rats

|  | ALT (IU/L) | AST (IU/L) | Bilirubin (mg/dL) |
|---|---|---|---|
| PBS | 53 | 83 | 0.21 |
| ISIS 483817 | 81 | 127 | 0.13 |
| ISIS 483910 | 283 | 428 | 3.38 |
| ISIS 484085 | 131 | 208 | 0.27 |
| ISIS 484137 | 63 | 98 | 0.16 |
| ISIS 484215 | 50 | 86 | 0.13 |
| ISIS 484231 | 75 | 106 | 0.17 |
| ISIS 501871 | 45 | 73 | 0.10 |
| ISIS 502098 | 57 | 156 | 0.12 |
| ISIS 502163 | 85 | 177 | 0.21 |
| ISIS 502164 | 67 | 94 | 0.15 |
| ISIS 502194 | 54 | 82 | 0.15 |
| ISIS 525443 | 50 | 82 | 0.13 |
| ISIS 525474 | 118 | 136 | 0.22 |
| ISIS 525612 | 313 | 314 | 0.18 |
| ISIS 525708 | 65 | 117 | 0.16 |

Kidney Function

To evaluate the effect of ISIS oligonucleotides on kidney function, plasma levels of creatinine and total protein were measured on day 53 using an automated clinical chemistry analyzer (Hitachi Olympus AU400e, Melville, N.Y.). Results are presented in the Table below, expressed in mg/dL. Urine levels of creatinine and total protein were also measured on day 53 using the same automated clinical chemistry analyzer. Results are presented in the Table below, expressed in mg/dL.

TABLE 151

Kidney function markers in the plasma (mg/dL) in Sprague-Dawley rats

|  | BUN | Creatinine |
|---|---|---|
| PBS | 20 | 0.44 |
| ISIS 483817 | 22 | 0.40 |
| ISIS 483910 | 24 | 0.42 |
| ISIS 484085 | 19 | 0.37 |
| ISIS 484137 | 22 | 0.43 |
| ISIS 484215 | 19 | 0.36 |
| ISIS 484231 | 21 | 0.39 |
| ISIS 501871 | 23 | 0.31 |
| ISIS 502098 | 25 | 0.42 |
| ISIS 502163 | 21 | 0.37 |
| ISIS 502164 | 23 | 0.43 |
| ISIS 502194 | 21 | 0.44 |
| ISIS 525443 | 24 | 0.51 |
| ISIS 525474 | 22 | 0.39 |

TABLE 151-continued

Kidney function markers in the
plasma (mg/dL) in Sprague-Dawley rats

|  | BUN | Creatinine |
|---|---|---|
| ISIS 525612 | 18 | 0.38 |
| ISIS 525708 | 31 | 0.53 |

TABLE 152

Kidney function markers in the
urine (mg/dL) in Sprague-Dawley rats

|  | Creatinine | Total protein |
|---|---|---|
| PBS | 227 | 193 |
| ISIS 483817 | 95 | 2129 |
| ISIS 483910 | 60 | 1030 |
| ISIS 484085 | 87 | 868 |
| ISIS 484137 | 84 | 517 |
| ISIS 484215 | 146 | 1115 |
| ISIS 484231 | 89 | 652 |
| ISIS 501871 | 52 | 3426 |
| ISIS 502098 | 64 | 550 |
| ISIS 502163 | 73 | 522 |
| ISIS 502164 | 100 | 554 |
| ISIS 502194 | 95 | 410 |
| ISIS 525443 | 73 | 595 |
| ISIS 525474 | 79 | 1547 |
| ISIS 525612 | 94 | 453 |
| ISIS 525708 | 41 | 2043 |

Body and Organ Weights

Body weights of the rat were measured on day 49 and are presented in the Table below. Liver, heart, spleen and kidney weights were measured at the end of the study, and are also presented in the Table below. ISIS oligonucleotides that caused any changes in body or organ weights outside the expected range for antisense oligonucleotides were excluded from further studies. 'n/a' indicates that the particular endpoint was not measured in that group of mice.

TABLE 153

Body and organ weights of Sprague-Dawley rats (g)

|  | Body weight | Heart | Kidney | Liver | Spleen |
|---|---|---|---|---|---|
| PBS | 485 | 1.6 | 3.5 | 14.5 | 0.9 |
| ISIS 483817 | 362 | 1.2 | 4.2 | 17.0 | 2.3 |
| ISIS 483910 | 358 | 1.0 | 3.2 | 19.0 | 3.0 |
| ISIS 484085 | 348 | 1.1 | 2.9 | 15.3 | 1.6 |
| ISIS 484137 | 353 | 1.1 | 3.0 | 14.2 | 1.6 |
| ISIS 484215 | 391 | 1.2 | 3.7 | 16.6 | 2.0 |
| ISIS 484231 | 386 | 1.1 | 3.2 | 16.6 | 2.5 |
| ISIS 501871 | 322 | 1.1 | 3.5 | 17.4 | 1.8 |
| ISIS 502098 | 315 | 1.2 | 2.9 | 15.8 | 2.3 |
| ISIS 502163 | 326 | 1.0 | 3.5 | 14.5 | 3.4 |
| ISIS 502164 | 381 | 1.2 | 2.8 | 15.4 | 2.2 |
| ISIS 502194 | 439 | 1.3 | 3.4 | 18.6 | 2.0 |
| ISIS 525443 | 469 | 1.5 | 3.7 | 22.1 | 1.7 |
| ISIS 525474 | 445 | 1.7 | 3.8 | 19.2 | 2.2 |
| ISIS 525612 | 427 | 1.5 | 3.1 | 13.1 | 1.4 |
| ISIS 525708 | 338 | 1.0 | 3.6 | 15.9 | 2.3 |

Example 16: Effect of ISIS Antisense Oligonucleotides Targeting Human DGAT2 in Cynomolgus Monkeys Cynomolgus monkeys were treated with ISIS antisense oligonucleotides selected from studies described above. Antisense oligonucleotide efficacy and tolerability were evaluated.

At the time this study was undertaken, the cynomolgus monkey genomic sequence was not available in the National Center for Biotechnology Information (NCBI) database; therefore, cross-reactivity with the cynomolgus monkey gene sequence could not be confirmed. Instead, the sequences of the ISIS antisense oligonucleotides used in the cynomolgus monkeys was compared to a rhesus monkey sequence for homology. It is expected that ISIS oligonucleotides with homology to the rhesus monkey sequence are fully cross-reactive with the cynomolgus monkey sequence as well. The human antisense oligonucleotides tested are cross-reactive with the rhesus genomic sequence (RefSeq No. NW_001100387.1 truncated from nucleotides 1232000 to 1268000, designated herein as SEQ ID NO: 3). The greater the complementarity between the human oligonucleotide and the rhesus monkey sequence, the more likely the human oligonucleotide can cross-react with the rhesus monkey sequence. The start and stop sites of each oligonucleotide to SEQ ID NO: 3 is presented in the Table below. "Start site" indicates the 5'-most nucleotide to which the gapmer is targeted in the rhesus monkey gene sequence.

TABLE 154

Antisense oligonucleotides complementary to SEQ ID NO: 3

| ISIS No | Start Site | Stop Site | Sequence | Motif | SEQ ID NO |
|---|---|---|---|---|---|
| 484085 | 14986 | 15005 | GTCTGGGAACAGCAGCATCA | 5-10-5 | 1371 |
| 484129 | 18207 | 18226 | GCACTGACATGGTAAGTCCT | 5-10-5 | 1415 |
| 484137 | 18355 | 18374 | TGCCATTTAATGAGCTTCAC | 5-10-5 | 1423 |
| 495576 | 7054 | 7073 | CACCATAATCTGCACAGGTT | 5-10-5 | 1849 |
| 501861 | 19517 | 19536 | TCACAGAATTATCAGCAGTA | 5-10-5 | 2959 |
| 502194 | 27298 | 27317 | CCTCTTAGAAGTAATGCTTC | 5-10-5 | 3292 |

TABLE 154-continued

Antisense oligonucleotides complementary to SEQ ID NO: 3

| ISIS No | Start Site | Stop Site | Sequence | Motif | SEQ ID NO |
|---|---|---|---|---|---|
| 525443 | 2716 | 2732 | TCCATGTCAGAGAGGCT | 3-10-4 | 4198 |
| 525612 | 14990 | 15006 | GGTCTGGGAACAGCAGC | 3-10-4 | 4373 |

Treatment

Prior to the study, the monkeys were kept in quarantine for a 30-week period, during which the animals were observed daily for general health. The monkeys were 2-4 years old and weighed between 2 and 4 kg. Eight groups of 5 randomly assigned male cynomolgus monkeys each were injected subcutaneously with ISIS oligonucleotide or PBS using a stainless steel dosing needle and syringe of appropriate size into the intracapsular region and outer thigh of the monkeys. The monkeys were dosed 3 times a week for the first week (days 1, 3, and 5) as loading doses, and subsequently twice a week for weeks 2-13, with 20 mg/kg of ISIS oligonucleotide. A control group of 6 cynomolgus monkeys was injected with 0.9% sterile saline subcutaneously three times a week for the first week (days 1, 3, and 5), and subsequently once a week for weeks 2-13.

During the study period, the monkeys were observed for signs of mortality, clinical observations, and body weight, qualitative food consumption, ophthalmoscopic and electrocardiographic examination, clinical and anatomic pathology. Scheduled euthanasia of the animals was conducted on day 93 for animals assigned to terminal necroscopy and on Day 182 for animals assigned to the recovery necroscopy. A full panel of tissues were taken, processed to slides and examined microscopically for histopathology. The protocols described in the Example were approved by the Institutional Animal Care and Use Committee (IACUC).

Hepatic Target Reduction

Target Gene RNA Analysis

On day 93, RNA was extracted from liver tissue for real-time PCR analysis of DGAT2 using primer probe set mkDGAT2 (forward sequence CCGCAAGGGCTTTGT-GAA, designated herein as SEQ ID NO: 13, reverse sequence TTCTCTCCAAAGGAGTACATGGG, designated herein as SEQ ID NO: 14, probe sequence CCTGCGCCATGGAGCCGAC, designated herein as SEQ ID NO: 15). Results are presented as percent inhibition of DGAT2 mRNA, relative to PBS control, normalized to the house keeping gene CyclophilinA. Similar results were obtained on normalization with RIBOGREEN®. As shown in the Table below, treatment with ISIS antisense oligonucleotides resulted in significant reduction of DGAT2 mRNA in comparison to the sterile saline control. Specifically, treatment with ISIS 484137 and ISIS 501861 resulted in the significant reduction of DGAT2 mRNA expression.

Inhibition levels with select oligonucleotides were also measured with the human primer probe set RTS2977 MGB. As presented in the Table below, treatment with ISIS oligonucleotides significantly reduced DGAT2 levels. Specifically, treatment with ISIS 484137 and ISIS 501861 resulted in the significant reduction of DGAT2 mRNA expression.

TABLE 155

Percent Inhibition of DGAT2 mRNA in the cynomolgus monkey liver relative to the saline control (mkDGAT2 primer probe set)

| ISIS No | RIBOGREEN | CyclophilinA |
|---|---|---|
| 484085 | 20 | 21 |
| 484129 | 54 | 52 |
| 484137 | 71 | 69 |
| 495576 | 70 | 66 |
| 501861 | 89 | 88 |
| 502194 | 26 | 29 |
| 525443 | 49 | 48 |
| 525612 | 35 | 43 |

TABLE 156

Percent Inhibition of DGAT2 mRNA in the cynomolgus monkey liver relative to the saline control (RTS2977_MGB primerprobe set)

| ISIS No | RIBOGREEN | CyclophilinA |
|---|---|---|
| 501861 | 82 | 79 |
| 484137 | 63 | 58 |
| 525443 | 22 | 17 |

Secondary Lipid Gene RNA Analysis

Gene expression analysis of secondary lipid genes, DGAT1, ACC1, ACC2, FAS, and SCD1 2 was also performed. The results are presented in the Table below, expressed as % expression of each gene compared to the PBS control. As presented in the Table below, treatment with ISIS oligonucleotides significantly reduced lipogenic gene levels. Specifically, treatment with ISIS 484137 resulted in the significant reduction of mRNA expression.

TABLE 157

| | % lipid gene expression | | | | |
|---|---|---|---|---|---|
| | DGAT1 | ACC1 | ACC2 | FAS | SCD-1 |
| sterile saline | 100 | 100 | 100 | 100 | 100 |
| ISIS 484129 | 85 | 95 | 95 | 122 | 64 |
| ISIS 495576 | 82 | 66 | 59 | 65 | 40 |
| ISIS 501861 | 140 | 69 | 67 | 51 | 22 |
| ISIS 484085 | 118 | 122 | 86 | 281 | 123 |
| ISIS 484137 | 81 | 99 | 77 | 115 | 51 |
| ISIS 502194 | 103 | 91 | 81 | 114 | 63 |
| ISIS 525443 | 118 | 87 | 75 | 57 | 25 |
| ISIS 525612 | 170 | 106 | 96 | 83 | 42 |

Tolerability Studies

Body Weight Measurements

To evaluate the effect of ISIS oligonucleotides on the overall health of the animals, body weights were measured at regularly and are presented in the Table below. The results indicate that effect of treatment with antisense oligonucleotides on body weights was within the expected range for antisense oligonucleotides. Specifically, treatment with ISIS 484137 was well tolerated in terms of the body weights of the monkeys.

TABLE 158

Body weights in the cynomolgus monkey

|  | Day 1 | Day 15 | Day 29 | Day 36 | Day 50 | Day 64 | Day 78 | Day 85 |
|---|---|---|---|---|---|---|---|---|
| sterile saline | 2734 | 2795 | 2775 | 2719 | 2743 | 2739 | 2807 | 2779 |
| ISIS 484085 | 2759 | 2785 | 2822 | 2762 | 2815 | 2812 | 2910 | 2911 |
| ISIS 484129 | 2780 | 2889 | 2906 | 2852 | 2918 | 2937 | 3043 | 3029 |
| ISIS 484137 | 2756 | 2793 | 2847 | 2763 | 2850 | 2823 | 2906 | 2900 |
| ISIS 495576 | 2748 | 2865 | 2905 | 2823 | 2869 | 2908 | 2996 | 2979 |
| ISIS 501861 | 2702 | 2775 | 2797 | 2750 | 2775 | 2828 | 2893 | 2860 |
| ISIS 502194 | 2817 | 2886 | 2902 | 2840 | 2926 | 2929 | 3038 | 3045 |
| ISIS 525443 | 2790 | 2835 | 2814 | 2767 | 2790 | 2772 | 2843 | 2859 |
| ISIS 525612 | 2921 | 2962 | 2995 | 2937 | 3006 | 3020 | 3093 | 3166 |

Liver Function

To evaluate the effect of ISIS oligonucleotides on hepatic function, blood samples were collected from all the study groups. The blood samples were collected via femoral venipuncture on day 93, 48 hrs post-dosing. The monkeys were fasted overnight prior to blood collection. Blood was collected in tubes without any anticoagulant, and kept at room temperature for a minimum of 30 min for serum separation. The tubes were then centrifuged to obtain serum. Levels of various liver function markers were measured using a Toshiba 200FR NEO chemistry analyzer (Toshiba Co., Japan). Serum levels of ALT and AST were measured and the results are presented in the Table below, expressed in IU/L. Bilirubin, a liver function marker, was similarly measured and is presented in the Table below, expressed in mg/dL. The results indicate that antisense oligonucleotides had no effect on liver function outside the expected range for antisense oligonucleotides. Specifically, treatment with ISIS 484137 was well tolerated in terms of the liver function in monkeys.

TABLE 159

Liver function markers in cynomolgus monkey serum

|  | ALT (IU/L) | AST (IU/L) | Bilirubin (mg/dL) |
|---|---|---|---|
| sterile saline | 40 | 42 | 0.20 |
| ISIS 484085 | 57 | 52 | 0.15 |
| ISIS 484129 | 43 | 43 | 0.16 |
| ISIS 484137 | 52 | 57 | 0.16 |
| ISIS 495576 | 56 | 45 | 0.15 |
| ISIS 501861 | 70 | 67 | 0.16 |
| ISIS 502194 | 88 | 54 | 0.16 |
| ISIS 525443 | 56 | 45 | 0.23 |
| ISIS 525612 | 38 | 37 | 0.23 |

Kidney Function

To evaluate the effect of ISIS oligonucleotides on kidney function, blood samples were collected from all the study groups. The blood samples were collected via femoral venipuncture on day 93, 48 hrs post-dosing. The monkeys were fasted overnight prior to blood collection. Blood was collected in tubes without any anticoagulant, and kept at room temperature for a minimum of 30 min for serum separation. The tubes were then centrifuged to obtain serum. Levels of BUN and creatinine were measured using a Toshiba 200FR NEO chemistry analyzer (Toshiba Co., Japan). Results are presented in the Table below, expressed in mg/dL.

The plasma chemistry data indicate that most of the ISIS oligonucleotides did not have any effect on the kidney function outside the expected range for antisense oligonucleotides. Specifically, treatment with ISIS 484137 was well tolerated in terms of the kidney function of the monkeys.

TABLE 160

BUN and creatinine levels (mg/dL) in cynomolgus monkeys

|  | BUN | Creatinine |
|---|---|---|
| sterile saline | 25 | 0.87 |
| ISIS 484085 | 26 | 0.94 |
| ISIS 484129 | 21 | 0.81 |
| ISIS 484137 | 24 | 0.94 |
| ISIS 495576 | 22 | 0.92 |
| ISIS 501861 | 25 | 0.90 |
| ISIS 502194 | 27 | 0.86 |
| ISIS 525443 | 26 | 1.08 |
| ISIS 525612 | 23 | 0.98 |

Example 17: Effect of ISIS 484137 Targeting Human DGAT2 in Cynomolgus Monkeys

Cynomolgus monkeys were treated with ISIS 484137 to evaluate the safety of this antisense oligonucleotide over a 13-week dosing period followed by a 13 week recovery period. The protocols described in the Example were approved by the Testing Facility's Institutional Animal Care and Use Committee (IACUC).

Treatment

The monkeys were 2-4 years old and weighed between 2.3 and 3.7 kg. Five groups of 6-10 randomly assigned cynomolgus monkeys each were injected subcutaneously with ISIS oligonucleotide or 0.9% sterile saline using a stainless steel dosing needle and syringe of appropriate size into one of four delineated sites on the backs of the monkeys. The monkeys were dosed on Days 1, 3, 5, and 7, and then once weekly thereafter for a total of 13 weeks at dose levels of 4 mg/kg, 8 mg/kg, 12 mg/kg, or 40 mg/kg of ISIS 484137. A control group of 10 cynomolgus monkeys was injected with 0.9% sterile saline subcutaneously using the same regimen. Toxicokinetics were assessed in a sixth group of 14 animals (7 of each sex) at the 8 mg/kg dose level. Recovery was assessed in the controls and at the 12 mg/kg and 40 mg/kg dose levels of ISIS 484137 (2 per sex).

During the study period, the monkeys were observed for signs of mortality, clinical observations, and body weight, qualitative food consumption, ophthalmoscopic and electrocardiographic examination, clinical and anatomic pathology. Scheduled euthanasia of the animals was conducted on day 93 for animals assigned to terminal necroscopy and on Day 182 for animals assigned to the recovery necroscopy. A full panel of tissues were taken, processed to slides and examined microscopically for histopathology.

Body and Organ Weight Measurements

To evaluate the effect of ISIS 484137 on the overall health of the animals, body weights were measured at regularly and are presented in the Table below. Organ weights were measured after euthanisia. 'n.d.' indicates that there is no data for that timepoint. The results indicate that effect of treatment with ISIS 484137 on body and organ weights was within the expected range for antisense oligonucleotides. Specifically, treatment with ISIS 484137 was well tolerated in terms of the body and organ weights of the monkeys.

TABLE 161

Body weights (g) of cynomolgus monkeys

|  | Dose (mg/kg) | Day 93 | Day 182 |
|---|---|---|---|
| sterile saline | — | 3035 | 3075 |
| ISIS 484137 | 4 | 2848 | n.d. |
|  | 8 | 2850 | n.d. |
|  | 12 | 3125 | 3325 |
|  | 40 | 3027 | 2875 |

TABLE 162

Organ weights (g) of cynomolgus monkeys on day 93

|  | Dose (mg/kg) | Brain | Adrenal gland | Heart | Kidney | Liver | Spleen | Thyroid |
|---|---|---|---|---|---|---|---|---|
| sterile saline | — | 67 | 0.46 | 10.8 | 12.6 | 60.0 | 4.1 | 0.4 |
| ISIS 484137 | 4 | 67 | 0.52 | 9.7 | 13.2 | 60.8 | 3.9 | 0.3 |
|  | 8 | 67 | 0.51 | 10.9 | 14.2 | 73.7 | 3.6 | 0.4 |
|  | 12 | 69 | 0.56 | 10.1 | 14.0 | 65.1 | 3.2 | 0.3 |
|  | 40 | 69 | 0.59 | 10.2 | 15.8 | 79.2 | 6.2 | 0.4 |

Plasma Homeostasis

To evaluate the potential for ISIS 484137 to produce complement activation, plasma samples were obtained once prior to treatment initiation on Day −7, then following the first dose on Day 1 at 4, 8 and 24 hours, and finally following the last dose on Day 91 predose and at 4 hours for determination of complement split product Bb using ELISA. Serum samples were also obtained for measurement of Complement C5 on Day −7, on Day 1 (at 24 hours post dose), on Day 91 (predose and at 24 hours post dose) and for recovery animals on Days 121 and 182 using an automated clinical chemistry analyzer. Additionally, blood for coagulation analyses was taken on Day 1 (4 hours post dose) and on Day 91 (predose, 1, 4, 8, and 24 hours post dose) and evaluated using an automated coagulation analyzer.

At the 40 mg/kg dose level, indications of alternative pathway activation were observed as acute, transient increases in Complement Bb (up to 7-fold over baseline) at 4 hours post dose on Days 1 and 91. Complement Bb then returned to baseline levels at 24 hours on Day 1 or to near baseline levels on Day 91. There were no significant changes in Complement C5 observed during the study. Mild, transient prolongations of APTT (up to 29%), relative to controls were observed at 4 to 8 hours post dose and then diminished by 24 or 48 hours post dose. The acute transient increases in Complement Bb and APTT observed following treatment with ISIS 484137 were typical of those commonly seen oligonucleotide-treated monkeys.

Liver Function

To evaluate the effect of ISIS 484137 on hepatic function, blood samples were collected from all the study groups on Days 44, 93, 121, and 182 for determination of liver transaminases and liver functions. Serum levels of ALT and AST were measured and the results are presented in the Table below, expressed in IU/L. Bilirubin, a liver function marker, was similarly measured and the results are presented in the Table below, expressed in mg/dL. ISIS 484137 had no adverse effect on liver function outside the expected range for antisense oligonucleotides. 'n.d.' indicates that there is no data for that timepoint. The results indicate that treatment with ISIS 484137 was well tolerated in terms of the liver function in monkeys.

TABLE 163

ALT levels (IU/L) in cynomolgus monkey serum

|  | Dose (mg/kg) | Day 44 | Day 93 | Day 182 |
|---|---|---|---|---|
| sterile saline | — | 43 | 36 | 36 |
| ISIS 484137 | 4 | 31 | 38 | n.d. |

TABLE 163-continued

ALT levels (IU/L) in cynomolgus monkey serum

|  | Dose (mg/kg) | Day 44 | Day 93 | Day 182 |
|---|---|---|---|---|
|  | 8 | 33 | 31 | n.d. |
|  | 12 | 32 | 40 | 27 |
|  | 40 | 41 | 62 | 42 |

TABLE 164

AST levels (IU/L) in cynomolgus monkey serum

|  | Dose (mg/kg) | Day 44 | Day 93 | Day 121 |
|---|---|---|---|---|
| sterile saline | — | 54 | 65 | 41 |
| ISIS 484137 | 4 | 33 | 53 | n.d. |
|  | 8 | 50 | 53 | n.d. |
|  | 12 | 29 | 71 | 31 |
|  | 40 | 49 | 90 | 44 |

TABLE 165

Total bilirubin levels (mg/dL) in cynomolgus monkey serum

| | Dose (mg/kg) | Day 44 | Day 93 | Day 121 | Day 182 |
|---|---|---|---|---|---|
| sterile saline | — | 0.20 | 0.25 | 0.23 | 0.20 |
| ISIS 484137 | 4 | 0.17 | 0.20 | n.d. | n.d. |
| | 8 | 0.20 | 0.20 | n.d. | n.d. |
| | 12 | 0.20 | 0.35 | 0.20 | 0.20 |
| | 40 | 0.20 | 0.20 | 0.18 | 0.23 |

Kidney Function

To evaluate the effect of ISIS 484137 on kidney function, blood samples were collected from all the study groups on days 44, 93, 121, and 182. Results are presented in the Table below, expressed in mg/dL.

The serum chemistry data indicate that ISIS 484137 did not have any effect on the kidney function outside the expected range for antisense oligonucleotides. Similar results were found with urine samples of the monkeys. Treatment with ISIS 484137 was therefore well tolerated in terms of the kidney function of the monkeys.

TABLE 166

Albumin levels (g/dL) in cynomolgus monkey serum

| | Dose (mg/kg) | Day 44 | Day 93 |
|---|---|---|---|
| sterile saline | — | 4.2 | 4.1 |
| ISIS 484137 | 4 | 4.2 | 4.1 |
| | 8 | 4.3 | 3.9 |
| | 12 | 3.8 | 4.0 |
| | 40 | 3.8 | 3.8 |

TABLE 167

BUN levels (mg/dL) in cynomolgus monkey serum

| | Dose (mg/kg) | Day 44 | Day 93 | Day 121 |
|---|---|---|---|---|
| sterile saline | — | 23.7 | 22.5 | 23.0 |
| ISIS 484137 | 4 | 18.0 | 17.7 | n.d. |
| | 8 | 20.0 | 21.0 | n.d. |
| | 12 | 22.0 | 22.0 | 21.0 |
| | 40 | 21.3 | 20.0 | 24.0 |

TABLE 168

Creatinine levels (mg/dL) in cynomolgus monkey serum

| | Dose (mg/kg) | Day 44 | Day 93 | Day 121 | Day 182 |
|---|---|---|---|---|---|
| sterile saline | — | 128 | 81 | 120 | 93 |
| ISIS 484137 | 4 | 129 | 138 | n.d. | n.d. |
| | 8 | 69 | 79 | n.d. | n.d. |
| | 12 | 183 | 153 | 79 | 84 |
| | 40 | 129 | 85 | 74 | 72 |

Plasma Toxicokinetics

Following subcutaneous injection in monkeys, ISIS 484137 was quickly absorbed into the systemic circulation with a median $T_{max}$ (time to reach plasma $C_{max}$) ranging from 1 to 4 hours. Peak exposure ($C_{max}$) and total exposure ($AUC_{0-48\,hr}$) were dose-dependent on Day 1, Day 7, and Day 91. Similar AUC (area under the curve) values were observed between Day 1 (after a single dose) and Day 91 (after 16 doses). These results indicate a lack of plasma accumulation of ISIS 484137 following multiple doses. Mean clearance values ($CL/F_{0-48\,hr}$) following subcutaneous administration at all dose levels following single or multiple administrations ranged from 31.3 to 75.8 mL/hr/kg and appeared to decrease with increasing dose. The post-distribution plasma elimination half-life ($t_{1/2\lambda z}$) ranged from 9.42 days to 20.2 days following the 13 weeks of treatment. A review of ISIS 484137 plasma toxicokinetic parameters revealed no gender difference. The Table below presents the results. 'n.d.' means 'not determined'.

TABLE 169

Plasma toxicokinetic summary in monkeys for ISIS 484137

| Dose (mg/kg) | Day | Number of animals | $C_{max}$ (μg/mL) | $T_{max}$ (hr) | $AUC_{0-48hr}$ (hr*μg/mL) | $t_{1/2\lambda z}$ (days) |
|---|---|---|---|---|---|---|
| 4 | 1 | 6 | 15 | 1.5 | 59 | n.d. |
| | 91 | 6 | 7 | 3.0 | 53 | n.d. |
| 8 | 1 | 6 | 30 | 1.5 | 138 | n.d. |
| | 7 | 12 | 28 | 2.0 | 137 | 9.42 |
| | 91 | 6 | 19 | 2.0 | 127 | n.d. |
| 12 | 1 | 10 | 43 | 1.0 | 263 | n.d. |
| | 91 | 10 | 24 | 4.0 | 261 | 15.1 |
| 40 | 1 | 10 | 113 | 1.0 | 1030 | n.d. |
| | 91 | 10 | 92 | 1.0 | 1300 | 20.2 |

Tissue Toxicokinetics

There was a dose-dependent increase in kidney cortex and liver concentrations over the 10-fold increase in dose of ISIS 484137. Based on the mean tissue ISIS 484137 concentrations at the end of treatment and after recovery, the estimated tissue half-lives were 16.4 to 21.3 days and 17.8 to 22.8 days in kidney and liver, respectively, similar to the tissue half-lives determined following 8 mg/kg ISIS 484137. These findings are also consistent with the estimated terminal elimination half-life values in plasma. The Table below presents the results. 'n.d.' means 'not determined'.

The tissue half-life (approximately 2-3 weeks) observed supports an infrequent clinical dosing regimen.

TABLE 170

Tissue toxicokinetic summary in monkeys for ISIS 484137

| | Intact ISIS 484137 (μg/g) | | | | | |
|---|---|---|---|---|---|---|
| | Day 3 (2 days after 1st dose) | | Day 93 (2 days after last dose) | | Day 182 (91 days after last dose) | |
| Dose (mg/kg) | Kidney | Liver | Kidney | Liver | Kidney | Liver |
| 4 | n.d. | n.d. | 610 | 221 | n.d. | n.d. |
| 8 | 594 | 84 | 889 | 406 | n.d. | n.d. |
| 12 | n.d. | n.d. | 1320 | 586 | 30 | 18 |
| 40 | n.d. | n.d. | 4220 | 993 | 233 | 66 |

Pro-Inflammatory Effects

None of the inflammatory marker levels were changed beyond the expected range for antisense oligonucleotides. Therefore, treatment with ISIS 484137 did not cause any adverse inflammation and was well tolerated in the monkeys.

In summary, 13 weeks treatment with ISIS 484137 was clinically well tolerated at doses up to 40 mg/kg/week. There was no mortality during the study and there were no treatment-related effects in clinical findings, body weights, food consumption/appetence, ophthalomoscopic and electrocardiographic examinations, hematology, urinalysis, or complement C3 levels during the study. Overall, the results of the study indicate that ISIS 484137 is the most potent and well tolerated compound of those tested for inhibiting DGAT2 and is an important candidate for the treatment of metabolic diseases, such as NAFLD and NASH.

Example 18: Double-Blind, Placebo-Controlled, Dose-Escalation Phase I Study

A double-blind, placebo-controlled, dose-escalation Phase I study to assess the safety, tolerability, pharmacokinetics and pharmacodynamics of single and multiple doses of ISIS 484137 administered subcutaneously to healthy overweight volunteers is conducted in a Study Center.

Treatment Protocol

Approximately 48 subjects are planned to be enrolled in the study: 16 subjects in the single-dose cohorts and 32 subjects in the multiple-dose cohorts. Subjects are healthy males or females aged 18-65, inclusive, who have given written consent and are able to comply with all the study requirements. BMI of the volunteers is 29.0-38.0 kg/m$^2$ inclusive. Any volunteers with clinically significant abnormalities in medical history are excluded from the study. ISIS 484137 solution or placebo (0.9% sterile saline) is prepared by an unblinded pharmacist or qualified delegate shortly before use, using aseptic technique. Study staff, who are blinded to the identity of the drug, administer the drug to the subjects.

There are 4 single-dose cohorts (Cohort A-D) with 4 subjects per cohort randomized 3:1 of ISIS 484137: placebo. The length of each subject's participation is approximately 8 weeks, which includes a 4-week screening period, a single dose, and a 4-week post-treatment evaluation period. Subjects receive a single dose of ISIS 484137 by subcutaneous administration. The dose of the antisense oligonucleotide to each cohort is presented in the Table below.

TABLE 171

Single-dose cohort dosing regimen of ISIS 484137

| Cohort | Total dose (mg) |
|---|---|
| A | 50 |
| B | 100 |
| C | 200 |
| D | 400 |

There are 4 multiple-dose cohorts (Cohort AA-DD) with 8 subjects per cohort randomized 3:1 of ISIS 484137: placebo. The length of each subject's participation is approximately 23 weeks, which includes a 4-week screening period, a 6-week treatment period, and a 13-week post-treatment evaluation period. Subjects receive 3 doses of ISIS 484137 by subcutaneous administration during the first week (Days 1, 3, and 5) and subsequently receive one subcutaneous dose once a week for the next 5 weeks (Days 8, 15, 22, 29, and 36) for a total of 8 doses. Subjects have follow-up visits at the Study Center on Days 37, 43, 50, 64, 78, 92, 106, and 127.

TABLE 172

Multiple-dose cohort dosing regimen of ISIS 484137

| Cohort | Dose per administration (mg) | Total dose (mg) |
|---|---|---|
| AA | 100 | 800 |
| BB | 200 | 1600 |
| CC | 300 | 2400 |
| DD | 400 | 3200 |

Blood and urine samples are collected regularly throughout the study for safety, pharmacokinetic, and pharmacodynamics analysis. The safety and tolerability of ISIS 484137 is assessed by determining the incidence, severity, and dose-relationship of adverse events, vital signs, physical examination, ECG findings, and clinical laboratory parameters. Safety results in subjects dosed with ISIS 484137 are compared with those in subjects dosed with placebo.

SEQUENCE LISTING (4679 sequences)

SEQ ID NO: 1 - DNA, 2485 bp, Homo sapiens
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaaaaaaaaaaaaaaaaaaaaaaa

SEQ ID NO: 2 - DNA, 42823 bp, Homo sapiens
gcagcagaagtgttaaagtttaagtgaaagttttaaaaaggggtatgtgtggttgtaaagaaggcttcttggaggaagatgcatcaagacaggacagatggacagggtgtgaaaaagggggagcttggggaagggcttgagctcaagagcacagtgtgggcagggacccagaggtggaaaagcacgttcaggggcagggcaagtgacctgatgggcctagggagctggacccacattagagcatggcggtgggagaggagtggaggcggctggagagagtggcaggagcaggatgatgtgaggccttgaatgccaagttaaggagctggggcctcatcctaagaactatggggagccacgagaaacaatggttgggttctgtgttctgaagctcattctgggaatctggagacaggggaccagtgaagaggatagtacagctgtctatgcaaggtggcatggcccaaggcagaagagagaaggagagaactgtttcctggttgttgggcatagaggtatcagtgtgaatgtttttgtatgtgtccatgagcacaagtaatctttctcagagagtcagcctaaaaaaaaaaaaaaacccaaccctattcagtttcatgacccagcatacccagcagcctgggggaggccaaagttaccaaagaaagaggctgagagacattcagttaaagcctgactttatagttcttcctcatcaacaccatcctgcaaattcacattcatctacaggctttcagggtgttttaatcccagttatctcacccaaaatatttgcttttccgcctttctttgtgtttcctgtatgcctcatgtcagcatccttgttcaggtcacttacttaaaaaaaaaaaaaaatccataaggccgggctgaggtggagcctggagtgaccaggaaaccactctagaatgaactcctacctgaggcagctcctcctccctagcagagcccacactggcctgctgatcacctccctgctcaggactctgctgataccatagacctagtcctaggccagtttgggaatctagagaggccattgaaaagaaaactgatatatggataccacccctcctcggtgactcaatcgtagctcctgacaactcagggttttgtttttttgtttgtttgttttttctcttgagggttacagagcatcatttatagaatgcagtttatacaactgacctcagaatatggccaggattttgcagctattatagagcatggtctctggagccagaccatctcagcttaaatcctggctctgccacttcctaagctgtgtgaccttgggcaattttttttaacctctttgtgtctcaatttctccatctgaaaaatggactcatatagtatctactccaaagggttgttgtgaggcttaactaaatccacccatgtaaggaacctagaatagtaactggcagacagtaaatactcactgaagtttaacacctgttatattgcctgttatagttcatgaaaactgttgcttctccttttggaaaaatcaggatggcactagcccacctccagtctcccaacgcttctccagctgaacagcatttcctagagattacagattctgtaatctgcaggttctctgagatgcagttggaacaatttaatacagcagagcagtcccatgctccactgtagtctcactgcaaaacagttcagcagcggttctcaaaatgtgggcttcaaactagcagtatcagcatgtcctgggaacttgttagaaatgcacattctcagcctcactccagaacctactgaatcagaaactctgggggtggaacccagaaagctatattttaaccagccctctgctaatgtttgaaaactgccacagcatattatagcacagtggtttatttaggtagatatggcgcagttcattgcccactccttctccacaaagtgttcctgattcccccagaaccctcttttactaacagctctaacttcctccctgtattactgttgtccatgctcaaaagtgctcaatcctccctggattacaggttacctgagagcagtgttgggtcttacacatctctgcactgggcagcccaggggctgccacagggacctttgcttaggaaagacatgctgagtcaagcgtgcaacatttccagtttcctctgactaaggctactattactgagcctctgctccttccaggacccttgctcatactgcattttcctttgtgaattgtggtcatctcctatgctaagatgcctggttctttgtcatttctagtatcctccagttccactgccttctcaggcattttactcttctccctccctttatgtttgttcaaagccctttggagaaggtgtcagagctccaggcaaacctgtcaccctaatccttattttcaatcataatacttctactggtaacaatttgtcaagtactatatgccaggccctgtactgggcattttacattcattcattcattcacttagagacagggtgtctctctgctgcccaggctgcagcgcagtgacacgatcatagctcactgcggcctctaactcctggactcaagcaatcctcccctccccctaccttggcctcctacgtagctgggactacagacacatgccaccatgcctaggtaattttttttttttgggtagagatggggtctgtctgtgttgcccaggctggtcttcaactcctgggctcaaatgatcctcatgcctcagcatcccaaagtactgagattacaggcatgagccattgtgcccatatggcactttacatttattattttagtctttacaacaaccctaggaggaagatacctattcccatttggatggagcacagggaaactgaggctcaaacacagtaagcaacattaacatgtggcaaggtgggggcttattcagtctggggccaagtcagggtctgggtggatggaccaggagaagggccttgtctaggcatatgtattcatataaaaatgatccaccaacaaacctgtccagtgcccttgctcaggaagatgggtctgaccaggtgccagcccaccagggtgcctttccacagtgtgcagggggcatccacctgaatgcccgtcttcagtgcatcccctggccctgcacttgctattctgtgcagcaggagtttcaaactgtgttccacagagccctggagatagggtgtgtgggctgggcaagtgagagacaaaccctgaggaactgtgggaccaccccagcagcctgtcatccctgtcacttcttgggctctcaaggttgtatttgaagaaatgatttcagctgggcgcggtggctcacgcctgtaatcccagcgctttgggaggttgagatgggcggatcacgaggtcaggagcttgagaccatcttggctaacatggcaaaacctcgtctctaaaaatacaaaaaaaaaattagctggatgtggtggcgggcgcctgtagtcccagctacttgggaggctgaggcaggagaatggcgtgaacccgggaggtggagcttgtagtgagccgagattgtgccactgcactccagcctgggcgacagaacgagactccgtctcaaaaaaaaaaaaaagaaaaaagaaaaaaagaaatggtttcactgcttttaaaaagctagaaactactgctgaataataattgtcattttaggtgtctgtttcttcccccagaatgcccctaaggagcaagaactgtacccacagcacccagcacaaggatggggggtctcaggaaaggtcggccagatagaagggcagatgagaaatgaatgtactgggagctctctgtgtaatatcccctcccccaccctcaccccaccccccaattcctgcagggaagaggccttgagagagttgagtaagaaataagcaggcagaatgatgcaaggggagctgtctgtacacattgcaacagaactttctaaaacaagcctggggctgctcccaagggtctcagtcctgccctattcctctactgtcatccagacctgtcacacaagatagggccaaaggccattaccaagctctgctaaggcctgaccttagagctgggaggtctgtgctcttgggttctggtttgaaacccggagccatcttcaatcacccccttccttcctttcagccctacatccatgccatcaaatcctagagactctaaagcttcagcatctctcaaaatcaccctcgcttctcttttgccttgccaccccttcagttcaggctctgtcgtcattatctctctccttcctctcatctgcctccctcccttccatccaatatcacccaggtccctgtgggttgtctgtgccccttcagcaaaggccacagcttccatgtggcagccctctccgctcagcccccattgcacctgcagtgtccttctcttagtccttcaggccagatcccctgtgaggtgactagtcctgggctactgcaccatcccttgagttttctctatagcctgcttacatctttgcaaacagtctttgtattaaactgtcctcaaattacccagtttgggtgggctgtttcccatagggacactgactaatataaggtagaggtagttaggaagggtgccatggagatgacagttaaagatgttcttgcctggacaatgatctttctaaagcataaaactcctgctaaaaacctctatggctccccattgccctgagaataaagtccagactctgtagcctgccacccaagactatataccatcaggcccctgaccacaaagcagcagcagcatgtggggaagccaccaggaagagggagagtagggggcttggacgtgggaggcaaagacttccaagaggagtgcagccatgccacacagctgctctggctggcaaattcctgtgagtaaggaggcgggtgagtttccaggctagagggccatgccaggctgcctctgcttgccagaaccctgcccgcccactctccaagtgagttgagcactgaaaggagtttaaccccaatgggccctagccttgtggcatgagaactggttacatcccaaccccatctggtaagctattggattccctgagctttcattttgccaactgcaaaatgggactaacctcccagggctgtggaggcgatggatgggaatttgctttcgtccagtagttctgctgttacaggtgctccctctcccagccttgggaggcaggaaaagcgtacaggtttgaggctctggaagacttggtgtgaatctcagctttactacttactccttgtgtgatccaggacaagtcactttacttccctgcaccccatgtgcaaagcggtgggggtgatcaccccttgtgtggtggctgtgaggactgggcaagctcacacaagccagggcctagcacagagcagggagcttgatacacgtttgtttctgtctttctacctgtgcctctcttagggcaagtgtcctctctgccttataggctggccacttaccctcctcatgtgtgcaatggaggagctaagactgctatcactgaagcatatctcagaggtgcatgcgtcaaacctctcacaagctacaaagctgcacgtgtaatccccaatggctgtacaacactggtgattgaagtgggtggaggatgagccatccttgtggatgcctctctgctcacacccctcctttggtccatcccccaacaggatgaagtccaagcttcttggtgggaccacaaagcccaccctggtcaagcccttcttggaggcatgacttgaccggtctctgattttcccaatatacacatgggttgagagatgatgaaggaaaggtaaccaggtcctagaacacattctcaagctgttctgctcacacacctgcaggaaggtcagggctggtcattataggaggctaggaatgtcaagaagcatgggagggggccaggagaagtcagagtctggtgtaagtcccccttgcccaaactcacacaggggaaaacagtcccaggacacaggaagctgccatgaaacttcctttccaggctactctaagtttgggtctggttttccttccaaatccaatttggaccaagctgtttaagcagtacccatgggcatggcggctggaggccaaggggaaggagtgttctagaagttgggatgccaggggctgcttgctctgtgaggtggcacagaagtaagcaattgtgcctctcagcccttggactcacctctgcgtcctctcacagatgttcccacacaggaagggcccaagctggggaccagattttatggccctattccccaagcacccacctccaccccaacaacccagcttatcttccttttttttttttttttttgagtcttgctctctcgcccaggctaccaggctggagtgcagtggcacaatctcggctcactgcaagctccatctcctgggttcacgccattctcttgcctcagcctcccgagtagctgggactacaggcacctgccaacacgcctggctaatttttgtatttttagcagagaggaggtttcaccgtgttagccaggatggtctcgatctactgacctcgtgatccacccgcctcggcctcccgaagtgctgggattacaggcgtaagccaccgcgctgggccccagtttatctttctaacccaccaatccaatcaaggtgcatctctgctcacacccctcctttggtccatccccccacaggatgaagtccaagcttcctggcaggacccacgaggccgttcagatctgggccctgtcaacctctccagcctcatttcctacccctcttctgcctgtatctttctttcagccacaccagggtgctcacagggttcctacctccaggcctttgtccatgctgtaccctctgcctgacacctttcccctttccccctgcctcacagaatcagacttctcatcttaggtctgcagcaatatcacttcttcttgaccttcccaatttaccattccctctacttcctctatgactctactatactttttcagggggcaatccaccttggactaagcgtctatgccgagctaggcccacactgggacatagagtgatgaggttcctgcccttgggaaacgcctggctccgtggagaggcaggcagacagtgacagcacagggggaaaggccaaacttggcatagccttccatgttaccctgtgccacaggctggctgtcttgggatcattggctttaggacaccatctctcgattgggtctcctcaaagccaaggactaagtccgattactctctgtgtcctaaccaaggccgggcccagagaaggtgcatagcaaaaatgtgctgaagtagatgaacttgggatctgaatgtttcaaataggccttggtaaccccaaatcttgccatttaagacaatgatctcttacattacagcacagtgataacactcttttacatgctgtgatttcacttcatcctcaaatactcaagtgaagtcagcaaaacagaaactgtcacctccatttcataatgcagaaaaggaaacctagacaagatagcgatactgacttgcccagggtgagtgggtgggccatgagttccagcccaggcctcctccacaggagacccttctggagcaggcacgagccacagactgacctgggatcttccaggccagcaggagtcttgcctccaagagcaccctctctgaggagaggatgccaggatttactggcaccttcagtatcctcctggcttcactcctctttgcccaaaaacaaaccacacctgtttctacctcccagcctttgcacttaccagtccccatgtctccccccatcccccacatgtggcatgccactagcctaccctcagtttcctaaaaggcactaagatctttccagcctcatggcctcaccacatgctgggagctctgcctggaatgcttttctttctactcttggccaattcgggccttggggcccagtaacacggttgagagatttactcctgtggccttgagagggctgaacaaatggaagcatctctaggttgcaccagaggcatctattacctgctgccctgtgcctgtaacttctgtcattctcctctccccctgtgagaacatgataaagaccacaaaggcagggaattcctctcctcttatgctgtgaccccacagctatctcgctccagctatgcctaagaaatctgtcttatcactgacatgcttgttgtccccactcgttccctgagcctccatccaacaagtcgctccaccacatgctggtggatctcgcttcctatgctcttccctagatcaggccttccctccattccctctaccactgccgtgccttgaggctcatcctctctcacatggatcccccgcccctacagcctccccactgccctcctgacctacagcctctcctgtccatttcccataccatggctaaggacacttaaaacccacctgaccagccatttccctactaaagctctcccaagacccggctcccccccaatatctcaagagtggcactcccaaacctctctcagttcaagcacccgcgcctctcacttcagcctcattttccacagttgcctgggctccagccactccagggcccccagccctgccccaaacatgctggcttttctaacactttatgcctatctttctgctttgccctcacaccttccatctgcaaaattcctattcattaatgggcaaaccattctggaatgctttctatgtgccagacactacctaggctctttttataccttatctcatttacttctcaaagtacctcacaaaaataataattattattcccattttacagatatggaaactgaggctcaagagaggcagggcaagaactggactcctagtctatctgattccaaacctgctgtgcaccaacctctctgggaagtgcaccagcgcccccactcccccagcccagggcagagtcttctctactctgtggttccatagccccctggtttctcgcttgtcccggccgttgtcaccagtgactgtgtgcggctgtctctgctgccccccagcgtgagcatcccaagggcagaacctgggctgatctggctgggtccccagcacccagcagggtataggtgctctgtgaggtttcttaataaagagatggaaagccagaagcagtttgggtggttgagatacccagccctaacctaactaatcctgataccagtgaccaaaagcgggaccttcgcatctttgctgccaaaagacagcccctcctaaagagtaaaggcccgaccccctgcacgccctctgcctgcaccgcacgtgcttggttttccccgcccgggtactggccgccgggccgtaccaatctccgcgggggagcgcccggggtcggactgagggagcgaggggaataaccgggcgcgccccttggaagcagggctcagagctgctctcctctcacgcattccccggatccgcgcggagcaggctgctggccagccccgggcccgcgccaagcagagcctcaggtgcggttcccccacaagcaagtggcgcgggcggcggcttagaacggcccgccccgcccgccgcgtcggcgcctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggtgagtgccacggcgcaggggttatggacctgcgagaagattttctggaaagggccctgtggcaggctggtgggtactgatgagtccacgttcattctccactgtggcactcatcaatttttacgacctctgttacatcgctttccacccgccccccagcttgtttccctcatccgtgaggtgggagcggtaccacccaccattcttagttattagggatattcgagaactcctccccagcccccactgcggctggtgacccctggcacttccctcccctctcccttcaccaggtagagcgagctttggcagtgatagactggatgggcaggatggtatgggttttgccgtctcctgagacagccaccagacggggaacatgcccgactggaacaggtgtgtctgccctgtcctctgtcccacatccatcctctcgcccaggctctggagcccacatagcagcaactcttgagcctggcatgcttagaaggcagcggagaggaccctgcatgtcctccaaggtagaactgaggtcctcagtgaatcgcgcagagttgaaatcaacccccgccccgcaccccccgcagcttttcccaagcgaggaatagcaactcttccaacccccacctcccttacctagagctggagaaactgaagtgggaggaagcatgcctaagttttccttagctgatgccttgacccctggattcaagtacaaatccggtagaccctgggaagtcatcacagctgtcctggtctgcgtgtgtgtcttgcatgaagcccctctccctctttctaagtctgtattctgtttgctgagcctctctgacatggatttttctttagtaactaacggtcgcctacaccgcccacctttgttacaaaaataaagcttgctaattatggaatttttgaaaatatagacaaatgaaaaaaatttctggtaaatcgactatccaaagataccttcctattagcattttagtatatctcttgatcattttctttatacacattgcatagatacaattgaggacatgctgtagatatagttatgaatcttgttttctcccccttaatgtaacatcgaggtttcccttctgttaatcagaatcacttacaatgtcctagtggttgcaataacccaccctgcagctgtaccacactttaactgtgacctaggcattggcattgcttcttgtgtgattatcgctgtggttatctgcccctcttggtgtgggtgctgctcgtagcccttgaagaggaacccagctgctgccctgtctcgggggcgagcagcttgagctgccccatgtatccagccagtagcctctgacagccccttctctcacttgagtccttttctgttccctgtgtcctttgatgtccttagggacatcaatggatgaatggacttgcccttgttcatgctgttaaaaatgtttttgcactgggcagtgggatagggatgttctctgtggtagtgcttcctggagaccccattccgtcggctctgccatccacaggctgggagctgtgtcttccaggaggcagtgaccctggctgtcatgtttttgacttagagtttgttccttaggagaacttgtactctagcgaatggttttaaccaagccacttaatatcatgtcaggaacatttccccatgttgttatcagatcttgaaaacttttttttttttaaactgggtgcaaggatttacatcatggaatgtaggaagggctggtatgaaatgcaaaccagtcagttcagctttctgggatctactttggtgaaagattgggtggagtaggggagggcactgaagcacattttgttatctgggcatctccattagacctgccttctagatccttggtccttgaagatactccccagtggcctagtttgcctctgtgggtaaggtcccactgttgtgagctggtgaacagcccgtcagtgacagtattcaagtagagaccatggattctgtgaagggaagtcctgtgacgggtgagagattgaaatagataccttggcatctggtttcttggccaaaaaaaaaggccagctgtgggagtatgggtaggtgggtgcatgctgggggaagcgggagtctgtgttgatatttcctaatccttggagggctgtcctgtgccagacgtggagtttgcagagttcatcaggacaggagggatatatatcctattctttatccttgcctttggattgggggctcttcgttcagaagagccctctgacacctgcctgtgtcctcagggttcagcacaggacctagcatgagatgttggtggtcccagtaaaattttgagctgatttgttgtgtgcggctccaaagagtgaggccaggaataggagtgggatgatgggtgcaagttttgatgtagcagaggagtcctttctgacagctgttgaggactgcaacaggctggggtgggtgaggatggagttccacatcactgtggatctgcttgaaactaagtggctagattgttgggggtaactgggaactgagggttgacagtcacctaacctagtcctaagtcagaatgagaacattactctcatgcttccctctccaattccgtgtggcttcccccctcacctacatcacttccccagctgaatagaggccactttggggctgcgtcaccaagggctcatctaggctgagaaaggagggccaagagtaatgttgtattaacaggctcagtgactcaatggtcagtgttgaaatcctgccccacctccaccctcctgccctcaaattcaacagcaagtacttgagttgtaaaaattagtgctggatcgggcccaaccctcatgttacagatgggatcactggagtctccagaaagaagggactttcccagggttatcaaagccaggctagaactcagatccatctcccagtctgtggcctgactccttaagccaagagaagggttgcaaggccgtgaagggctgagtgcagggctctgtgcattgtaggtgctcagtggtttgctgaatgagtgaaggttgtctccatggtgcgggtggcagctcatcccttctcaaactttttgaggaagctccccaagcctgccctagtggattagagcactaagatcccccagagctttggctgccaggtgaatgccagttgccccctacccacactcagtcacacttcagactttccaaactcttcctcctggcctatgaagtaagccccaggtgaacagcctccactgccatcacgacttcctctcctagtatgtcacccaccatgctgcagacgcatggtggtcttcctgttcctgcagcattactcccaattcagtcttacctcagcgcctttgcatatgctgcctgtctgcccaggtcttcgcatggctggctttacaacagtcaatctcctctcagaggtcttccctggccaccctatctagagagccacttccaatctagagagccacttccaatcaccacatcttcttttatttttatagcctttatcactacctaaattttcatgcgtgcttatctgtttaagcaattgtctccccagtaagaatatcagtccctttgccggccgcgtgccatggctttcgcctgtaatcccagcactttgggaggccaaagtgggaggatcacttgaggtcaggagttcgagaccagcctggctgacatggtaaaacccctgtctctactaaaaataaaaaaatttagccaggtgtggtggtgtgtgcctgtaatcccagctacttgggaggctgaggcaggatagtcgcttgaacccaggaggaggaggttacagtgagccaaggttgtgctactgcactccagcgtgggtaacagagcgagactccatctcaaaacaaaacaaaaagaacaaacagaaaaagaatatgagtcccttggaaacaggaaccttgtctgtctttctcagtgctgtgacatctagcacagtgcctggcactggtaataggtacttagtaagtatctgttaaacgaaggaatcattagtgggactgccccattcctcttggaggaagccctgcttttagcttcagtgtgattcctcgagccttccttgggcctcctctgtccctgtaaccacctgtgctagggactgggtgctggggttgtagctgttccctgccctggaggtacccacagtctggcaaggagctggctccaaggctgagtggcaagtgggcagagccagtctcaatggtcacccttactgcttcccagggcttattagaagcccgagagctggggttccaggcctgacatttttctgggatgtggctgggggcttcacttcctctctggggatctcactccttctatctggaaaatagggtcagaattctcagattctcaaggatggagggtttgagttaacctgagtgtgagtgtttgtgaacttgtgacattcatgttagtccttgtcatttgtcctgtgttacacattcagcaggcccccaacactgtagagagtggcagaccctgctctagggcatccaggaaggcttcactgaggaagggacttggggtgtggacccttcattttattgattgagcaccttctgtgtgtcagctgcagtccctgcgtttgaggaagtgagaccagggggatgtacacaagatgactgtgcagagtgatctgagcaatgacaggaaagactgccaagaggtgagaccggggagcttgatcaccctgaggtcagggaagtcttcctggaagaggtgacattcagtccggatctggaaagatgaatagacatcagcaagacaggcaagaacattcaggtacaggaaatagcataaatagaggcatgagatttggatgggagaggcagactgactgcagggcctctgagtgaccaactgaggctgaggtcttggtgtactgagagccagagacaagagagacagagaggatgctggatccaggcctgtggtggctcacctgtgtctgcagcaggaggaagacttgagagctcatgggaaaggagcctggtgcagttagtttattggcctccagcactttgagggcctcctggtatggagctgctggctgatttgagggcctcatgggcagggcccaggggtaggagtcaggcctgggctctgtccagctcctgcttggccaccgaactgctccgcagcctcagcaagccactacccttccttaccctcagtctcctcatctatgaaatgagcaaaagtgtcataagaacctgtgcagattatggtgcagatgcagacaggctacaccctgtgaaccttttgggtaaatcaatagaaatgggaaacacaaactccttttcttattagagcagaattagccattctaagccctgcctctgcttcccatgtgaccttgggtataacactgcctcttagggcctcagccttctcatctgcacagtgaggaggactggttgagatgacccccttggcttccttacatccctgctggagaaatgcgattccattcttgtccctaactgctgtgggactcttgaggtcagccacctcctcattcttgtcctcagcttctccttgtgaaaatggtgcactcatccacttggggccaaggtaagtgccccagaagaacctgtctccccatgcttgcccatatattgtgatggggacgtattttggagattccttggtgacctactcgcaagctagtagtgttgccatggcagccccttccactgcagtagctactttttgaatgtgcttggtcacagtgggtggggtgggggaagtgggcccctggggtcctcagcaatcatgtccagggtcctggatgtagatccatgttcggtatcaggaacatggcattctaagagtctcacttccttggccttacctcttggaactttgtgaaagttctacttgatgaaaacggaatacacaaaaacccaggtgtatggagtagcccgaggatgggcttatattccctttcgggagatcttctgtggataaaaattcatttgtggattctagcagagcacaggtggcccaagttagcagcactcagatttcaacaaatccaccccagcttcctaatttagtgctaatggggaaacctagagaggggaggaagaggcttagcgcccctgcaggtctacagatgctcaggatgcctggctccctgcagcaggccctgaggactgacagtgcctgcagggtcctgatggcccacttcccacctggcacacctagcatagctgtgtgctggctctccagtagtttggcttcccctttgggccagatgtcccagtgggccctgctttaaggatacctcatttgcaaaacagaaccgttaaagcgaattgttaatcttttcagaaaagaactcactggcgttttgggaccagttctatagctagctagctgccctagggctcttaggcaccagtggagggagtgagctctgactggctgtcttctctgccttcagggtagaggccaggactcctagacctagcatcccagtccttcatgcctccctgtttctctacttttccaactagactcacagtctctgtgctgcagtctgactaaactgcttgcagttaattcctcaaacttgtcttctctctgtttcgggcctttgcaatgccttctgggatcctgcccctgtaccttcctcctggaaggcatccctaagaacaccctcctgtgggggttggggcctcccctggattcctagtcctgactgatcctttatgtataattgttcgcagctttgtctcccagccatatcttgggtgggcagcccaggagcagaactcagcctctagcagatgcccaagaagcagaggagaagcagagtctagaagctcccctcctggtgtggagcctggggtgtaaagggtacttagaaagcactggtatgaatgttagtgtttgggttccacccttctctctcccttcctctggggccttccaccattgccccgacattaaccaccctccagctggagaagacctttccctcctgattccccagaaagctctgcttgaccctccatcatggcacaggtcagtcagctgtgggtggacttttttctatctttgtctaggccctgtttattcatcacagtcctctcaagcattcagtcattcagcaaacatcgatcgagcaccttctctgcgcctgaccctgtgctgagcaccagggcccagatgaatgagacatggtccctgcaaatgcacacacataccttttcccataatgagaaagggctgagtacaggggtgagatgggacaggcagggatgcggtcaatccaacccaggtggaggagaaggaagactttccagagaaagagtcaacaggttggtctctagcaggccagtgctcagtgcctggtggatgcctggtatgcatgtgctaaaagactgaccaaactagacttagaagcaatagaactctacctggaggcactgcagtgaagtccctccttcctggagggaacgagtctctggctgagcacatggtgaggcaccaagtggagacagcttcctgtgtgaggcttacgggagcccagccctggcctgggattctaatagcagtgggcatgaccctccagagatggcagctttgccatgaccggcctctcatcatcatgtgtgtggactcccgctgaaaggtgtctgcctggaggagcctggaagagagctcacctccagccttgatgaagtggcatctctttggcacttggcctgacttcctagacctccctggggctggaagagcctgctaggggtcaatatgtactgaccctcactctgctacctctcctcataatatacaacctgttactgtgcacctcttaaaaaactgtttgctctctctgtctccgtgcaacttgtcctcagctctttgggggtaacttgggggtgactttctcactcacctagacccagggcagacattaggtccagatgggcccaggtgtggcatccttggggttggggatgtgggcagggtgacccccacccccacccctgcctcaaggagcccaagaggctgttcacacctctcttagctggcatctttctggctctctcacattgatgccagacattctggcccttttccctaagttatttagattccttatgacaatcctggattaaagctaaggaggacactgagtcccagggacagggagtgatttgcaaggtctcattgcaggtaagaatcagagccagggtttgaatcctaagttagcctgtcgcctacgcctctgttcctaggcagggcaggcattattttacccatcaaacaggagaggacaccgaggcttacttggtaattaatcagcattcatagagatctttactttttatgaagctcttggctatacattatctcatttaattcccacaacaatctggtgaggtaggtattagccccactgtatagatgaggaagctgaagcttgtataggaagtgactcatccaggccacttcctacgagttagaggccaggttctcctgactctcggcccctgttttcggcactgactccaggttggcatgtcccctgccagatgccagtatggaggtgaggtgggtggaggacgcggtgtgggctttcgagaggcgtgagctgcccacagtctctgtctaccagtgcttcgccatgtacgctcagggcctcctctccataggccagggatcctcctgcccctctctctatctcattgccccaaattatttttcttcatagctctcgtcgctgcctgatgttacatcatacattaatacgtaggtgttttatctctccctcagcagaagttaagcatcctaacttaactttagccagtctgacttgggcatccaggcctatagctgcctctgaggcaggacatcatctgctgtgctcactgctgtttccccagggctagtattagcgcttagtaccttgtatgtgctctatgccttgggtcttagctctgtccccacccacctcacccaggaagccacctttgactactcattccaacttctttattctcagcttctatttcaggcagtcactcacccccctttctgggttcttgagtatttgggtctgcctcattagaactccctgcaaggctttgttccagcagtttcccccaaccacagtgcgcactttcctcctgtttgacccctagatcttgtcttcagggccctggcgaagcctcatggcctccttggagcctcctctgcgctaccatcactctgcgacctcttcttgtaacacagacctgtggccatgagcctctggaaaaactctgcttgctcactacatatactccttcccactctggagatgggaggagcaatgccagtagccaccacttaatcacctaacaaatgccacatgtgccttaaacgttttaaaatttaatgttcctggctgggcgtggtggctcatgcctgtaatcgcagcactttgggaggcctaggcgggcggatcacgagatcaggagatcgagaccatcctggctaacatggtgaaaccccatctctaccaaaaatacaaataattagccgggcgttgtggcgggtgcctgtagtcccagctactcgggaggctgaggcaggagaatggagtgaaccctggaggcggaggttgcagcgagtcgagatcgcaccactgcactccagcctgggcgacagatcgggactccgtctcaaaaaaaaaaaaaaaaaaaaaatttaatgttccccaaaatcctgtgaggtgaggattatcaccctcatcctatagataagaaaaccaaagctagagttaggtgacttgcccgaggtcacagagccaggcaagggcagagctggcccagggccctctttctcagatttagggggttggggctcagacactgctgccctcaggcatgtgagaggaagccctgaaaacttgggtttcatcagccccgaggtgtggccttcctggtcactttgatatcagatattgggcaaagaggtgctcacagacacccttcaacaccccagccctgggctgggccctgggtctgagaactgcttgaaagcacatgggttgcgggggtggaatccagtctcactagaacatccacatgagactttgagcatgatatgggcagaggagggagctctcctttgccaggatatgttcctgaagtccaggtgtgggctggcgtgtttggtggggccagcgctcaacagcgtagcattgtagagatgatgagggactgggagcctgaataccttctttaagtcctggctcccacaccctgacctcaagcaagtgattttgcctctttgggcttcacctcacctcagtttccttctctgtgaaacaggattgccagttctccccttgcctaccttcccagagagtgctgtgggacggtgaagccccacataggcgcaggagaaggggattgctttccgggtggtaaaagagctgctctgggcctctctggcagctctactccctctgccttccccaaaggtaggagcaaatgagctgtgtgtaaagcaagtgctgcctgggagcagccatttgagtcttctgttgggaatcttcccctacagcctgtctcatctgcccccataaaacagagacatctgtaggtagcagggttgtgttccctttataggtggagaaacttgtacctagggagggcaaaagaggctcatcccccatctctggggtcagtcctcagtgatggggctggttttgcctcctgccaggcagcccagtctaacttgggcatccaggcctatagctgcctctgaggctgctctggatttgcttatggatttgctcagctatgcagtaaacctctatgagcccctcttaccacagatgaatcaggtaccaagtcctggcacccatgcgtcactggcagtgggatggccaagtaaagtgacattggtgctgtgggagtgtgcagagagagtgcagatgtggtgagggggcagataggagcagggacttggctggatgctgaggctccctggtggccccacccaggagtcaggaacagtcagactgggtgtgaaggtggtggcatgtggtggcatctgattgcagcatcggcatccccaccagcttctgctggactcctcccagccacagctggggcagaggaagtactgacagccaggtggcaaggactggcagtgttttgggggtgcccaactgaaccctcacttcccatctgcctgagcaacggtaccagaactactgcaagatggtaagctctaggtcccaaataccctgacaggagtcctcaggagggtgggtgccagagatcacagacttcaccctccttacccccatttcatagatggggaaactgaagcccagagaggtgaggagacttagcatgggagttggtggcagagctgggtctagaaacccaagtcctgctgccactctacctgctgtagaagatgcctgctcctgacccacccctctgaaggaaaacagatcattcatttctccccttccccttccagctccccaccactgccccctgctttgttgtggggagcagagagaaggaacttggggacatgcaacatcggagcagatgcaggcctgaaggttgggcctgaattgggttcagctttgccagcatctggctgagtgaccttgacccggtatcaccatcaaaatagggtgttggtgccaaactcacaggagtccaagtgcctgtgcaagggcatggagggtctcccaaagctttatgggcctcttgtgcatcatacctttcactcagccctgcatggagggaactccgggggcctgaagagtggccagagcacctccttggggctggcctgacagggcactggggatccagatatggatcagacccaggcctggccttcgggcagcttccagtgtgatggagaatcagcttgtaatcagcagttagaacaaggccagaggctgtgggaaccctgaggaggatgctcttttgtttctccattgtgcgggtctgactttatcttcaaataggttatttctgtgggtggcaagatagcccctggcaattccaggcctgcatagaccttagtgtttatcatcccagagaaggaaaggccttctctttccaaaggcttcctggaagactgctgccttatcaccatctctgggttttgaaggatgtattgctttatctcattatcagggaatcatcaggtaagcaaagcagggaagggcctctgcctagaatatttctgaggtggactgggggctcccactggcccggggttcagcatccatggccaggccagctcccaggccacggcctccatggtcagccaggttgggattgcctgagagggcctgggcctgagaaagcagaggtgcagtcctcccagcttccctctccaggagcctcccaactctaacgcccacggaagcacttgccatttggtatttgggacttagagctcaccaccttgcagcagtcccggtacagttgcccaggcagatgggaagtgagggttcacttggtagactgcatttcccacttgttggcagagcgagctgtgggcggtagttggggctggataaggcagggtgagaaccgaaccagcagtgtgggaaaagcctgagcctgcagacccaccttgctgcgggacttgggagactcccgcaggccctcaatttccagtctgtataacggggtgagggttgaacaagatggcgtgcgtttcctgcgctatgactttacctaattttaagacacctaataagcttagcagagagatttggattaggcacgatgaagaatttttaggtcttctcagttgtttcagttggggatatgtcatcagtgaaatttctatactcctcctccaagctgcatgggggctggccctggcgtcaaggtagggagctagataagttgactcccagcatgcctcttccctacgcacccctcaaaccactggcttcaggggcctgtctgcaacgggaagcaagtcagccacgagaaggcatgctttgcctttttttcctgccaaatagaaggtggtgttccccggtgctgtgtctcaccccagcccctacctgagtgtttggactgaagcatttatagtggtgtttctcagacttaatcacctggggatcttgttaaaatgcagattttgattcagtaaatccagtctggagcccaaagtcctgcatttctaacccgctcccaggtgatgctgatgctgctgttcccagaccacgctttgagtaggaaagtgctagagtacattttgtcttctgtctagccagggcatccagcctgcctcagatggaacaggaactcacctgccacttaaccagcctccggtggccatggctcctgcttcacttcatccagcatggctcaggaggcagagccagctgctggaagatgacttgtccagccccagcccttggatcaagggttcaagcctgtgcttggacttcacttccctcccttatatactcacccagtcctgtcccacttgtaggtgaaggtgaaaggttatgagaccctcaaggataagcatgtgatgaactcatctggccaggtcccactgctgggcaggttgaccaggccctgagcatgaccctccgactgtgtcctgtgtacagagcctttgcactcagagctgctctggggaaaggggaggtcctctaagcagggtcaggaatgctgggtttcagtcctggctctgccgcctactgcctgggtagccctgggctagtcagtgcctgtctctggtccccagtctccctggctgtccaattaggctatactggatgaccccagagggctctcaggctctaagatgggttgctgggcaagtctggaggtgggaaagtcctatgaaggtaggatttttgtaaagggggcgaaggagcaattatgaggcagacctctggaatggctctatggcccagcctctttatttgcttttgtgagttcacatcctgccgcctccaccccagttatgccagtggtgttattagatgctactgaacacccaatttgtgcactgaggatgtggcagtgaaccctgcaagcttgcctggggtcacatagtgagtagaaccaaagtctgaacctaggtttgactcttctgctaaactaagccctttccctctgatgcatcacaccagggaaaggggccatcttgaggcctagcatttccttccttcctcctaaaagtcaaagcagttgttaactttcagctcataagggtagatatctttctaaactctgctgtggctttgttgctttgcagattttgaagaaaagcaaaggcttgagtgtaggcccctaaatccgtctttctccctgctcccagcttgtaggctcagttgaaaggtcatgagaccctcaaggacaagattgtgactaactcatctgtgctctgggtctttcacagagcagatggtatgaaggaatatttaatgggcacacagtaggtgcttggtgaagatgtgttgagcaaagggcatgtagtgggggttcagcaaagaggggtttgaggtggcccacttcttcagctgccggaaggaatggggtatgggtgaggaaccttcacccatgctcttccccagtgctgtctcctgcagtcaccaggcttcctgtccctactgcccatcagctgctggagtccagggtgtcatcctaggggcaccaagccaattaagtgggcacatctcgtcctaacttccaggcttggcacttgattgatagtgaacataattacagccctcagtgtccttcaggctgcctgaagctcactggctactgggccctttggggaagcaaaggctcccaccttactcctttctgggccccacgctttgggcactgagatgaggctgaacatttacatctctctgaaagtggtagtggtgtggggaatcagtggtgttgggggtgggggcaagagggttcagctccttggagaaggggtattagtctgggacatacagaaggcagagcagggattggggatgctcaaagtacacttggagaaaaaaaaccattgcaaattggatgttgaacctctgtccttggcctcacagacagatagcaaaattaaatatttgtactagattcagataagggacaggagtttgactggggtggaggggatgggagagaactggcaattatgagagacttcccaaggcctagcccttggactagcctctttagatacttcatgtggtctccaaaatgaccccgagtgcgataccattcccattgtgtatctatagaaaccagggcacaggggagcatgcagacagcccagagttacaaagccatgaggtggagggctaggatctgaacccaggtctgtctgattctatagctgatgctcttctcatatctagaagggtacctgtgggaggtgaggtttgtactggggaccccatgactggagagaagggtgacagtggactgacatcttccctctgctgtaggcactggatccagcatcctctccgccctccaggacctcttctctgtcacctggctcaataggtccaaggtggaaaagcagctacaggtcatctcagtgctccagtgggtcctgtccttccttgtactgggtaagctgggccttagagggagggcaggtgggcaggcagtgtccacttccccaaaagaggtagagcaggagccctgctctacaggggtgagggaataagagtaactcttacacatgctgccccacagcacctttccacatctatcttttgggtcccagatcaagtgctctacccctcagcatgcatgaagattcagcaagattcagtgggaggtggtgtgatagttcccatttacagatgggaaacctcaagtcttagagaagataggtaacttgcccaaggtcacacagatttgaatccctgtctacaggacccccaaagcctgtgcctttcccacaatgccaccctgcccaccaacagacattttccagcaggtatgttactttgccttaaggtggtttggtgccaggtttaagtcctgaatctcctgcagacaagctctgtgaccttacacaggttatttgagctctctgagtgttagtttcctcattttgagtgtgaggaaagtgcctgcttcacatggcttttttgaggattgaagataagaaatgagagcacctggcacagggcctggtcatgatgggcccccattacatgggaatcatcgggaggtgccctcagaccccactcccagcccacacccatcctcagctgagcacattccccaggtgcttcccgaggcctgctccctgctatctctcagcacagcccacatcggtgctttggttgctttttctgcaggtctggctagataccctcactccttaggttgccatccaggccaggggcaggacaacacgaatgtctgaggggagggaagaagcctcttgtttttccccagacccctgtgctctcagcatagcaggtagcttcctcagcacgtcaaggcagatgaacctgctccagagcatcacagagtgcattccagtgcctgtgagccagtccctctgggcaacccactcttcgggactgtataggctggtaggggatcatcaggacttaccatgtcagtgctgagcagctgtccttcaggcaggtgcatggggcgctctgagactgagaccatgtttgcagggccaagggatagaacttcacaggtgagaaaatgcaaattcacaaaggttcatcaactacctgctactgtgaagctcattaaatggcagagttgggattttagcagaaactcagtgcattccccagggagcccacattcctggaagcccagaattagtgaactggggctgaaacagccagtcttcacctttaggcccaagaacgggctttgagtggggggatccatgaacccttaaaattagatgcaagattatatatgagtatgtgcacatttttctggggagaagggccatagctgtcctcaaagtcttacagggacaggtagcctcaagaagacaaacactggttggaagaactgagcaaactaaacagtctccctcaggactcagacccctaacatggcttgcatttggccacttactagaatcctagagtagtgagcacagtgtgaccccttcttgttaaaaaaggaagtggaggcctggcgaggatggagccttacttggggtcacatgagaagaaagtactgggaccaggacaagaacccagggactccagcctcccagaccccctgcctagtctgctacaccagctctctttgttccctgttgcaccccaaagctaccactatccctgtcttaatgggtctgggcctggctggtagggagctgagcagcttgtagaacaccagctcacgcagcatgtgatggggactggccccaggctataggttaataattgatcagacccaaccacagcccagaaaccggcccagcatcttctcaacaccctcgcctggcctcacctcgcctcgcctcgcataggtgggaacctggcctcgttggacaggcagatctcctgagctactgctaattactgccctcagcagccccagccactccttccctctgcctctcaaacctgctggcagaagctcacctggcaagcaaagaccgtggtggccctgttggtctctccctggaccagagatttttcaccactttgtgccatggaaccctctgtcattttgatgaggcctatgccctttctcagtgttttagagtatttaatacaaggtgcattggatttcaaaggaaactactgataataaaatataaatatctatacattaaaaaagctgattagacatgtagtaacaggtgcctttttattacagtaaataaaaagatctagcagcacatgtaataattactatagttcttaagtagtgatgagaagaaatgattttttttaagatatctgcaactgctacaaagttatatgaaaatacctttgttatttatttgtgtcataagtactgctgataattctgtgatttattatattggtaagtgaaggaaatgccacatttccataagagataagtgaaaatttagatgtcatttgtttccccatccaagtccatggatattgtgtgtcaggctgagtaagttcaaacatcatatttaattttcccaataccctgtaaggaaattaaggcttaggaatggggcttggccagcaagtggcagggccaaggctccaggtctgtttggtctcagagtccatgctcttcaccaggccacactgctgccttccctgccattgagcatccacaggctgccctgcaccacaggcctcgtggcttcagaattttgtatcacaagtgtctttgtaggccaccataatgtgcaggaagcaggtgatgtgtgaaagtggtcctgagccttccatgtgtggggcaaagcagggccttctaagcttctcatgagctcagcaacagtggtttttactgcagccccacaacctaagagcatggaaccagagcctgttgttcagaggacaaggattaggctctgagaaaggaaggtcatttggtggatttagttcatccttttgctcttcctgtgtttggtttctggggctggagagattaatctgacctggtttctgctcccaaggagctcgggctgaagggctgtctgttagtgggagtccaatgagggaggcagatgatgaaagggatggtgagtggtttcagagagggctgtggacacataggggaggggagggagcccccagctgagaaaggccaggctagaattcagtctctggataccccatcaggcctcttcttctccatccaggctgcctcagcagcagagtaaggacaagtgggtagggttaccccccttcccagagagaccagccctctaagcagtggggcctggagctcagccccctctggtccttttacccctcaagagagttagagatttctggaagctaggtttccaggatgctcagaccatagcctaaacctcatcgtccctatctggcccacctggagcatccacctagaggatgccactagaggagcctggatgcctgtagagtctggggggctagagtcttcccttttcaggcccaagaaagggaatcaggcagactgctgaacagtaagtatgactttgtaggcagcctttagacatagctattcaccaagctaccgtaagcttttcacagtttgcttttaacaggctcttgtaggctgcacatgcttccctagaaacttgtcttcccttctgcgatgtcacacccctaagctggtcctgaaaaattggacatctcgtcactctgtattcactgttcctcccaacaagagagttgtaccctgtttttagctaccctggggagaggctggctcaggagtctagaacagggctagattggggggcaacaaggggctaccatttccctccctttaggctcatggagagtctacatccagccttatcttctcccatgggaaaccaaaggaggctcaacatggtgagaagagagcatgacatccagagccaggcagcctacagcacctgggaccaccagggaatgggcacacagcaagggttggcctcccttcttgggcagtggaaaaagtcctagaaggagtccatgcttctcccaccaaacatgagtacctgctgcccttgcccttgtgctgaatgccaaggaccaaagaagatgcctccccacccagtgtgggaaattcacaggcaagagatgatatgtagatagtatgatattggggaacacttcttgaagagctgaggtctgagataggccttaaaggttgggtaaaaaatggaaagagagaagccctgctgagggcagctagtggcgagccatgagataaagcaggcatggcacaagctctccttcctttctgtgccaggctagattagtctctcttatgacctacaggcccagaacatggtgaccagtggaagccagcccccaggcaagtcttccaagtgtgctgttagggtttttttttttttacttttgagacagagattccctctgttgcccaggttgcagtgtagtggcgcgatcatggctcactgcagcttcaaactcctggcttaaggagtcttcccatctcagcctcctgagtagctgggactacaggcacatgccaccttgcccagctaattttttaaatttttttgtagagatggagtctcgctatgttgcccaggctggtcttgaatttctgagctcaagcagtccaccacctcagcttcccaaagtgctgggattacgggtgtgagccactgtgcctggctgctgaagtttttgaagacagggaggctgatgggctctgcgctttggcctgggacttcctggattgccgttatgttggaagggagccagccctcctcctgggcaagtgtcccctctccggtccctctagtgatggtctgggactttggtgaatttctaaagcctaatacagagaacggactgtagagtcagacctgtgtttgaatcctggctctgccactgtcctgctgggtgaccttgggcaagttatctcccccttgagcctcagtgttcttatctctaaaatggggcaaagtcaccctgccttacacttgagacagtggctcagccccagtcttgagatgcagaggcactgggtaggtgttccctccccttatccacagtgtctgggctgggtgctggcatgggggcgcacacaaggaggggacagtaagagcagcttcacaagaagctgaagcctatctcctttggtgctcctgtccagataacatggagcccatgggcccctcgatgccaggacagtccatcagagtctgggagatgaggctcctcttgtcccaggaatctgctcctacctgggctgaacattcctgtagctatttctcagggtttgtgggccccatgcccatggccctgggtgtgcctagcttagtgccacagtaaacactcactccatccaccatggcccagaggggagatgaagcccagtaggacctgacctgtggccatctgccccccaggagtggcctgcagtgccatcctcatgtacatattctgcactgattgctggctcatcgctgtgctctacttcacttggctggtgtttgactggaacacacccaagaaaggtaagtgcaaggcctcccttgccccacctctcattctagggatgctcttccccctgcacaagctgaagggcctcatcctgagtgctgtttcttttaacacccactttgtgaaaagcactggactagtccttttggggggaggttaaaagcccctcaaagggcactgttctggtcctgacaagagttcacactcagtcgagggtttgcataacatgaaggaatgaatgtggaaaggggcctgatgggaagggggcatggtgcatggggtgatggtcacctgcttgggtttcacactggccctgtcttgtctgccttgcccaaatgtacccccacccccaccaactctgtattttattccctggaaggtggcaggaggtcacagtgggtccgaaactgggctgtgtggcgctactttcgagactactttcccatccaggtaaagtgctgtgagtgttgttttgggagggtgggaatggatgggaaatctgaactcaggccttaacccacccacagggaagcaagtttagaccaagttggtctcttcatttcctttctactgtgtcactggctgtgctggggaccccactgctcttctgagtatccatcttctttgggccagccctgaggtcctgacagggaaatggtggctcagtttggctttcagtctcagctctgtctggcccctgcctggtctgcaagctgggctggtgaggcacagccatctggccctgatgcatgtgggcaatcctggtgaattgaggataactctggcaggatcctgaaggttttccccacaggggaaagacctgtctggccagctcactccacaccccagctccagcacaccctagctgctgagtaccctgcagaaggtaggggtgctgaagagtggaggcagcacgtgaatgtgaaagagttctgtgcagggtgcagggtggtgtatatttgctgttgtgagtcagtgactgagatcctggtgtgttgcctgggggcagtggctgggtaaccctgcatccttcactgcattcggtattttgggggtggcagggccagctccttctgctcatccttagcctaagcccagtcttcccgggaccttcctgctcctcagggtcagcgttccttctccttttcctgaccccatctctctaactgcagaaaatttgaagctgtttttgttgggagaaagttgcatcataggacccaaccctctaattttggaggtaaagaaactgagcctcagagatgggcaggacttgtccaggctgcatagtctagtatgatggcaacattgcaaccaccatccaggcttattgaattcagggcccaggttcttttccactgatttcctactgcctgtttctctgggagagattcaatccctggatttccccattggattgattccagcttcctgggtctccctctcccccgttgctgctggagatctcagtttaagttcctgccctgtcactccatttattaacctgccaccattgctccctgtccagtgcagggctgtgctgggcatggggacacaagtcagccctgcccttggggtgtctattgcatcctgatagactttgtcactttctgccatggggccatgggcagactttctcaagcctgctgagcctcatctgcaaaatggagctgtctgtatgatgaaaagtaatcagttctgattgggtgggagtgatgatagactgttctttctgctttctctctcacctcaggggccaggctccagtgttctctgttgccactgtggcctggtcctctggaagtctccaggaggccagtagccccatccacttagaacaggatgacctgatgattgttggtcagacctgggacaggcaggtgtcctttgctatctgatctccacccttccaaaagaaccaaacaaacccctgtgtccttctcacatctctgttccaagaagtcagctgggagttggagccttagggcacatacaacctggccctgtgagggctccctggggcactaggacaaaagccaaactgggcccgaggcaggctggggtgttgagcctcaacccggggcttaggctgatcaacccggggcttaggctgagcctgcctctctccctctgggcctcaatctccccttcacttggccttggtgatctgacatcaggtctgacactctatgggggtgtgtgtgaccctcctgtcccacccccttttcctggcctcttgccagtaatcatgtaatgaagatctgccgctgtacccacccgcccacctactcccttcctggtgggactctggtctttgctgccagaacagctcatctggcccagagtgtatcccttctgttggcacaggtggggttcttgtgttagcaacagccaccgagaccaccagccacctggaagaggagcagacagtgccccacatcacctctccccaaagtgtaggcagaatccttggagaggagactaggaaacactctctctaagcttagaatcacctgtccatctgcctcatttcactgataggcttactgaggcacagagaggagggactatcccaaggtcacaaagcttaagtagtagcaggactagtgtaggaaccagggctgtctgctttggggcccatggtcttactcctgtgttactttcaccatcaccatgccgtgctgtgtaaacttaagcaagcctttgctcttctgtgggtctgaattttttcctctatgcactgctgtggtgggacaagcctatctgagcaccttgcctctcctgggagggagggtataaagagtgacttgataggaatgtgtcccagactgacattagcgagcaggccgggcctgggcatcgtgttgggctgggactttgccacgggaaacaggcagcaagaggacacaagagcaggcatgtcaacagaaccttcattggcggtatccttcccctccttccagaacggacattctctccagccctgggggaggggagtgtgacatgaaaacagatcagagctggtcagatgcctacattcttctgggtcctacagcaagggcattgacttgcactgtgtcccaaggcacctcattcaaccaaatgtcccatcagagccttggggagggaggaaatgatttaaagagccacctggggcccactgggtgacacatcttcatccagcagcccagggaaaagtgcagcgactggcctgctccagatgtgcaggataatttgctgtgacctccacaggggaattgcagctcccttttctaggcctcagcttccccccgtcatccaaggaatggcttagacctttcagggctctgccagcccatgcagtgctgtgggttcctggttatcggcccagtgggaaggtcgggggagccataggaaggggacaaaaagatgctgcacggcgtgatggtcacctgccagggtaactatcccaggcctggccatcagctcaggagcaagtttccaagtttcccacctggtattggctgccccagctcttccctcaatgcctgcctgcctttttcatcaaaactagcacaaggaactttttaattccagcttcactgagagctaacttggtgggcagacctgcttgttaggcaaaacattggaacagcaatcttaacagagctcatgtaaacgagattttgagatctgctcgctgccccgagccccactagctatggattagactgctgctgtttcccatttatttggggagtagctgagagttggtttggtttttgagcaactttaatctgtttgccaagggcaaagcgggagaaagagcatcagtgccccaagcagtggggatgagagtgagggagtcttgctcacatttgcacagactggcagcgtcagagctgggagtggtgccagccagccttttccatcccctctgtcacctgaagatttgcatttcaattttccaaggccagccaccagcaccctctcccccagagctgcacacaagtccttcagctctgccaggaggctcccaaatctggagtcacagaaaacctgggctcttgacattctgctggtggccagtgactctgcttccagctggcaccagtgcagggaaggggcactttgcagcactcaggtgggagtgtcattgatgtcacctcttttgaggcagggcagccaaaaagaccaacgtgttcattccttgttatccaggaattgtatttctagaagtttgtttcacaaaagcaatcagatatgtggacaaagataaggtatttattgaagcattacttctaagagggaaattttggaagcttttaaaatgtccatcaatcagggtttgagtcagtgctgttacatgcatgagagctgtgctgtagaatacaaatgcagccacgagaagatatggaactgagggattttgataaggacagatagctgtatgtttggtagaaaatgatataaaaatgatatcaacccatataacctcaattttgtgggttttgaaaaagagcatgtatatttttgagtagaaaaaggactcaatgcgtcagatggttttatctggatggaaatattatggattttttaaattttctttttgctttcctatatttttaaaattctctaggagtttctcttcttttccctctcccctcccctcccctcccctccccctcctccgttcctctcccctctcctccgttcctctgccctctcctccgttcctctcccctctcctctcctctcccttctctcctttcttcctttccttctttcctttcttctcactctgtcactcaggcttgagtgcagtggtgcaatctcggtttactgcagcctctgcctcctgggctcaagccatctttccacctcagcctcctgagtagctgggaccacaggtgcgtgccaccatgcccagttaatttctgtatttttgtagagataagcgtttcaccatgttgcccaggctggtctcaaactcctgagctgaagcaatcctcccaccttggcctcccaaagtgttgggataacaggcatgagccaccatgcctggccctattatttttctaatcagaataaaaatgatgtttttatgagcagaatacccttactcattgtctctctcagcctcttccacccccatcacattccttgtaacacagggtaggtgtcacaggctttgcctctcatgactcagggtttagggacactgcatcacccaccccttcaagcaccagccccagggcaggaggtgggccctgaggaagccaatcatcgtttagagcatcccagtgtccttagtaccacaggtcaggtcctcagctgctgcagccttacaactaacctctaccccaggctggctggcacagggctgtcgcttgtcctgtcttgtccttcctgccttagaacctgaactgagcccagctgactgtgggaaagtttccatttgggccagctgcagtgtcccttttccaggccaggggagtaggaggtgggctgcctgtctcattctgtgagctgtggaggagcccacagagcacagggccaagtaaaccctacctccaaggagctcacagtttggagagactgacagtgggggcagagcttgcagccaaggccccggttgccaaactcaggaacttggactttactcacatgaagccagacacactctccagtctaagagtgacaagggttggatttgagttttagaataatcactctggctgttgcgaaaaggatgggcccagagggagggaaggcaggaggctggcagagtgcaaagaagagctgctgtgtgcatggctgaagactgagaggaacaagggcaaacattgcccaccccttcccagagacccacagtgcaaatggtgactgcccaacaccagcactgtggccctggggatgagagtctgaggtaaggtgtggagattcattgcagccctcaggcccatggaggtccaggggaaatgacacatccaatccctccctaccctccgggtatgccccggtatccctctcccagccagtttcctctgacccaaggtcatccttgcagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtaagaatccaccccctgtgctcctgctgggcactgttgtcaaggcctgagcctctccatcgggcagggtgacacagggagccaacacaccattccttggtgctgggcctgcattgggagatgcaacctgcttcagacatggtgggtcagggctgaggaggagagctgtccatatggtcttgagaattcaactcggataacatcttccctaggaggccttctttgacccccttttctggggacccccagcccttgtgttgccttttgtacaacctgattgttgtccatggcactgtaattgtccacctgcctgagacctcccaccagactgatgcattgggatccccaacacctcgcaccgacttggcagaattagggccctgggaatgtttgccaaatgcatgagttcccaaaacaaccttgtatcattagctgcattttacagatgaggaaactgaggctcagaaaaatgaatagcttacacagaaccagacaactccaaaggggctgggctaggtctggggcccaggtccagggttctttatgttttatacctgactgtgtgccggggatggggagtggatccatgggcaaccctgactgttgcgtccttccctcccctcaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatgggtgagtgcctccctacacacacacacacccctccagtgcccctcagcccagggcagcagactccttggcccctgaagacaggacccagaccccaggaaggcatggaagggagtcagtcattctgttagggaggggatgttggagcccagactgcacagtgtgggccaagtttgcccatgtgtgtctgggtgggcacagatgcaacctgtggcctgtgggcccttgcaggtgggccgagagtccaggcttatatgcaggactggaccacctggggccagaatatatcattttgctgggagaccaggaggtcaggaaggagggtggtgtggaatgtggctgggggacagcagctgttttctctgtcccctggggaccttacctcaggctttggaagaagaggctgccctgcaggctcagccctgggccagcccctggggacacattcatattggacccagtccctgccttcagggagcaccaagggtgggggagggtagagggatggacagtgacaacacagtgtgctgagactgtgaaacaatggtgagtccagggctgagagaggcctggtttggtggagggaccaagagaacttcctggcagaggcaggccctgcaggaagaggtggaaaacaggcattccagagcagggcgctcagccttccctttgcctgggggacccagagctctgatatgctccccagtccctagcagtggggcagaaggcccatcagaacctggtagagagggatcatgtgaacttgggacacccaggtaattctggtacacccagctgggggagggggatgcttggccagtgtccagggcctctaggctgacatagaaactgaagccagtaagtagggtatgacagaccctggcctctcccttccagagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttggtaagcccctagcctgcagaccaagggctgtcctgaacacagggtgccatacagctaatcagcagtagagacgggattccaatgcaggccacctggctctgatggccatgcccttagccatgaggactttgaagtgttgggtgctgatattggtcaggaggggtagtagtaggagtcggggaattgagcctatgggatgaaccaagctctgtgataagtgaggaaagaaaatctgcagtctctgggtttgcagcacccactagtctatcagggaagactattgcagcaaagactagtgggggaatgtgatgaggatgcgcaggtgctctagggagtcatagcggaccccagggaggaggtaactcttgcactgctaactgataggaattatctagcaaaatagaggaggaagagaatttttatcagaaacaatagcctacgtgaagttcagaagcaagattgtgtagtttttttgaagaacagaaagaaaaacattaatatgactgcagcatagacctgtcagaagagtggaaaacactggttgcacttggccctcgtctgtgttgttttgggtgtatttgggaccatttagaggattctaaagaattacctattgtaggtgtgtgtgtgcatgttaatggatcccccaggagcacatgggcccttggcagtggacttgaggggccaaagctcacacagatcctttgcgttcctaggccaggtgtcctgccttgtacttttaggtagagacaaagcaacagggaggcagcaggaacatttccatgcacaggtgtggctggggaggggctgggtcctgtgggcaatgtgaaggaatttgctcttcaccttgagaatggagagccaccagagagtgtttgggaggggaagttcagatttgcatttaaaaatgatccttggagctgctggatggaagatgggttagaaaaatggaagccacgagaccagcccagagactgttttggtagccagtggcttggaccaagggagtagcagtggagatggaagagatgtgcatgatttgggaaaaatttcagaaatagcattggcaggacataggaatggattgggtatggagatgcagcaggataagaaaataaagcaacgcacagatcataaatgctggtctactccctcctctcctgcccttaaccacactttttattttttttttttttatttttgagacagggtctcattctgtcatccaggctggagtgcagtggcgcaatctcggctcactgtaacctctgcctcctagtctcaagcgatcctcccacctcagcctcctgagtagctgggactacaggcgtgcaccaccacacccagctaattttttgtatttttttttggtagagacgattttcaccatgttacccaggctggtcttgaactcatgagctcaagcaatctgcgggtctttgcctctcacagtgctggaattacaggcgtgagccaccactcctggcctacactttttaaagcatgtcacattccttgcagaatccttagaaaacccctatgaggaagaatccccatgtgacagatgaggaaactgagggtcagagaggcaggaatggcttgcccagagcagagcaaaagcaaagatgtttacttgatcccctgactctcatagaccctcctagcagaatgcagtgggttcaaccagtcttgatcccatctgcagcttagcacctggtggcctcgggtgggtcccttcacatgcccctgggcctcagtcttttcatctgtaataggggacaaccagagatgcagcacataaagcatttggcacagttccttccacatggcgggcccacagcccagcgtcaccaccttcagcatcatggtggatgcccaggggaagggtgttgactaaccagaagcctctgccctgtccctgcagtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctctatgagttattgctggggctgcatctgcatctgctgctgacacctggggaagactgggtccccagctggctgccctctgagccctctagccccttgcacctttggcccacatgaccctgccatggtgtgtaagttacctgtcactgtgtaacaaactacttcagagctcagtggcttccaacagcatctgttgtctcccagttccaagtcacgatttgaggcttggcttggtcctccactcagggtttctcacagggctgcagttgtcttggagccgggctgaggaaggatccactcccaaggccgttcctgcagttgttcgcaggattgacttcctcactggctgttgacagaggccactttcagttccttgccacatgggcctttccatggggtagct

SEQ ID NO: 3 - DNA, 36001 bp, Macaca mulatta
  misc_feature (1291)..(1524): n is a, c, g, or t
  misc_feature (33714)..(33733): n is a, c, g, or t
tcttatgctgggatcccacagctagctcgctccagctatgcctaagaaatctgtcttatcactgatgtgcttgttgtccccactcattccctgagcctctcatccaacaagtcactccaccacattctggtggatcttgcttcctatgctcttctctagatcaggccttccctccattccctctaccactgccatgccttgaggctcatcctctctcacatggatcccccccacagcctccccactgccctcctggcctacagcctctcctgtccatttcccatactatggctaaggacttttaaaacccacctgaccagtcatttccctactaaagctctcccaagacccggctcccctcctgatgtctcaagagtggcattcccaagcttctctcagttcaagcacccgcgcctctcacttcagcctcattttccacagttgcctgggctccagccactccagggcccccagccctgccccaaacacgatggcttttctaacactttatgcctgtctttctgtttgccctcacatcctccatctgcaaaattcctactcattaatgggcaaacaattctggaatgccttttttgtgccagacgctacctaggctctttttgtaccttatctcgtttacttctcaaagtacctcacaaaataataattattattcccattttacagaaatggaaactgaggctcaagagaggtagggcgagaactgggctcctagtctatctgattccaaacctgctgtgcaccaacctctctgggaagtgcactagcccccccactcccccagctcagggcagagtcttctctcctctatggttccataacccccggtttctcgcttgtcctggccgttgttaccagtgactgtgtgaggctgtctctgctgccctccaacgtgggtatcccaagggcagaacctgggctgatctggctgggtccccagcacccagcagggtataggtgctgtgtgaggtttcctaataaagagatggaaagccagaagcagtttgggtggttgagatacccagccctaacctaactaattcccataccagcgaccaaaagcggaaccttcgcatctttgctgccaaagtacagccccgcctagaggaaaggccagaccccctgcaagtcctcggcctgcaccgcacgtgcttggttttccccgcccaggtaccggccgccgggccgtaccaatctccgcggggaagagcccggggcggactgagggagtgggggaaataaccgggcgcgccccttggaatgagggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccgcccagttgtgaggtgataaagtgccgcgctcccggacgccagcaccgccgtcgcagtcgctgctgcgccgtaggttgtttctcccgcgccgcctctggccgactggccgaccggccgcagctccaggtgtcctagccacccaacctcggcgccgtcccggggcccccgtgctctgcgcgaagccctggccccggcggccggggcatgggccaggggctcggtgtgaggcggcttcccgcggggccgtgactgggcgggcttcatattcagccatgaagaccctcatagccgcctactccggggtcctgcgcggagagcgtcaggccgaggctgaccggagccagcgctctcacggaggacctgcgctgtcgcgcgaggggtctgggagatggggtgagtgccaccgcgcaggggttatggacctgcgagaagattttctggaaagggccctgtggcaggctggtgggtgctgatgagtgcacgttcattctccaccctggcactcatcaatttttgcgacctctgttacgtcactttccaccccccggcttgtttccctcatccgtgagttggaagtggtaccacccaccactcttagttattagggatattcgagaactcctccccagcccccactgcaactggtgaccccttcaccagttagagctagctttggcagtgagagactggatggggcaggatggtatgggttttgcagtctcctgagacagccaccagacgggggacatgcccgcctggaacaggtgtgtctgccctgtcctctgccccacgcccgtcctctcgcccaggctctggagcccacacagcagcaactgtgagcctggcatgcttaggaggcagcggagaggaccctgcacgccctcaagggtagaactgaggtcctcagtgaatcgcgcagagttgaaatcaaccctcaccccctacccgctgcagcttttcccaagcaaggaagagcagctcttccaacccccacctcccttacctagagttggagaaactgaagtgggaggaagcatgcctaagttttccttagctgatgccttgagccctggattcaagtacaaatccgggagaccctgggaagtcatcacagctgtcctggtctgcgtgtgtgtcttgcatgaagcccctctccctccttctaagtctgtattctgcttgctgagcctctctgacatggatttttctttagtaactaacagtcgcctactccgcccacctttgttataaaaataaagcatgctaattatggaaattttgaaaaatatagacaaatgaaacaaatttctggtaaatcgactatccaaagatagcttcctattagcattttagtatatctcttgatcattttctttatacacattgcatagatacagttgaggacatactgtagatatagttatgaatcttgttttctctcccttaatgtaacatcgaggtttcccttccgttaatcagaatcacttataatgtcctagtggttgcaataacccaccctgcaggtgtaccacactttaactgtgacctaggcattggcattgctccttgtgtgattatcgctgtggttatctgcccctcttggtgtgggtgctgcttgtagccccatgcatccagccagtagcctctgacagcccgctctctcacttgagtccttttctgttccctgtgtcctttgatgtccttagggaatgaagggacttgcccttgttcatgcttttaaaaatgttttggcactagacagtgggatagggatgttctctgtggtaggcttcctggagactccattccctcggctctgccatccacaggctgggagctgtgtattccaggagtcagtgaccctggctgtcatgtttttgacttagagtttgttccttaggagaacttgtactctagcgaatgattttaaccaaggcacttaatatcatgtcaggaacatttccctatgttgttatcagatcttgaaaacttttttttttttttaactcggtgcaaggatttacatcatggaatgtaggaagggctggtatgaaatacaaaccagtcagttcagctttctgggatctactttggtgaaagattgggtggagtaggggagggcactgaaacacattttgttatctgggcatctccattatacctgccttctagatccttggtccttgaagatactccccagtggcctagtttgcctctgtggataaggtcccactgttgtgagctggtgaacagcctgtcagtgacggtattcaagtagagaccatggattctgtgaagggaagtcctgtgatgggtgagattgaaatagataccctggcgtctggtttcttggccaaaaaaacaggccaactgtgggagtatgggtaggtgggtgcatgctgggggaagcaggagtctgtattgatatttcctaacctttggagggctgtcctgtgccaggcatggagattgcagagttcatcaggacacaagggatatatatcttgttcttcatccttgcctttggactgggggctcttcattcagaagagccctctgacacctgcctgtatccacaaggttcggcacaggacctagcatgagatggtggtgttcccggtaaaattctgagctgatttgttgtgtgtggctccaaagagcgaggccaggaacaggagtgggatgatgggtacaagttttgatgtagcagaggagtcctttctgacagctgttgaggattgcaacaggctggggtgggtgagggtggagttccgcatcactgtggatctgcttgaaactcagtggctagattgttgggggtaactgggaactgagggttgacaatcacttaacctagtcctaagtcagaatgagaacattactctcatgctcccctctctagttccgtgtggcttcccccctcacctacatcacttccccggctgaatagatgaatagaggcaactttggggctgcgttaccaagggctcatctaggctgagaaaggagggccaagagtaatgtattaacaggctcggtgactcaaagggcagtgttgaaatcctgccccaacttcaccctcacgccctcaaattcaacagcaagtacttaagttgtaaaaattagtgctggattgggcccaaccctcatgttacagatgggatcactggggtccccagaaagaagagactttctcagggttatcaaagccaggctagaacccagatccatctcccagtctgtggcctgactccttaagccaagagaggggttgcaaggccatgaagggctgagtgcagggctctgtgtattgtagatgctcagtggtttactgaatgagtgaaggttgtcttcatgatgcgggtggcagctcattcctactcaagctttttgaggaagctccccaagcctgccctagtggatgagagacactaagatcccccagggctttggctgccaggtgaactgccagttgccccctccccatacccactcacacttcagacttcccaaactcttcctcctggcctatgaagtaagccccatgtgaacagcctccactgccatcacaacttcctttcctagcatgtcactcaccatgctgcagacacacggtggtcttcctgttcctgcagcattactcccaattctgtcttacctcagggcctttcagcccaggtctttgcatgactggcttcagaacagtcagtctcctctcaggttttccctgaccaccctatctagagagccacccctaatcaccacatcttcttttatttttatagcctttatcagtatctaaattttcatttgtgcttatctgtttaagcaattgtctcccccataagaatatcagccccttggctggccacgtgccatggctttctccggtaatcccagcactttgggaggccgaggcgggaggatcacttgaggtcaggagtgtgagaccaggctggccaacatggtaaaaccccatctctactaaaaatacaaaaattagccaggtgtggtggtgcatgcctgtaatcccaactttcctgggaggctgaggcaggagactcgcttgaacccaggaggaggaggttacagtgagccaagattgtgccattgcactccagcctgggtgacagagtgagactccatctcaaaacaaaaaaaaaagaacaaacagaaaaaaagtatcagtcccttggaaacaggaaccttgtctgtctttctcagtgctgtgaccccagcatctagcacagtgcctggcactggtaataggtacttagtatttgttgaatgaaagaatcattaattggactgccccattcctcttgtaggaagccctgcttttagcttcattgtgattccttgagcctttctcgggcctcctctgtacctgtaaccacctatgctaggggctgggtgctggggttgcagctgttccctaccctggaggtccccacagtctggcaaggagctggctccaaggctgagtggcaaatgggcagagccaggctcagtggtcacccttactgcttcccagggcttattaaagccagagagccggggttccaggcctcacttttttctgggatgtcactaggaggggttcacttcctctctggggatctcactccttctttctggaaaatagggtcagaattctgagattctcaaggatggagggtttgggttaacctgagtgtgaatgtttgtgaacttgtgacattcatgttagtccttgtcatttgtcctgtgttacacattcaacaggcccccaacacagtagagagtggcagaccctgctctaaggtatccaggaaggcttcactgaggaagggacttggggtgtgaacccttcattttattggttgagtaccttctgtgtgtcagctgaagtccctgcctttgaggaagtgagaccggggaatgtacacaagatgactgtgcagagtgatctgagcaatgacaggaaagactgcaaagaggtgagactggggagcttgatcaccctgaggtcagggaagtcttcctggaagaggtgacattcagtccggatctggaaagatgaatagacattagtaagacaggcaagaacattcaggtacaggaagtagcataaatggaggcataagatttggatgggagaggcaggctgactgtagggcctctgagtgaccaaccgaggctgaggtcctagtgtactgagagccagagacaagagattcagagaggatgctggatccaggcctgtagtggctcacctttgtctgcagcaggaggaagacttgagagctcatgggaaaggagcctggtgcagttagtttattggcctccagcactttgaaggcctactggtatggagctgctggctgatttgagggcctcatgggcagggcccagggctaggagtcaggcctgtgttctgtccagctcctgcttggccactgaactgctctgcagcctcagcaagccactacccttccttaccctcagtctcctcatctatgaaatgagcaaaagtgtcttaagaacctgtgcagattatggtgcagatgcagagaggctaagactgtgaaccttttgggtaaatcaatggaaatgggaaacacaaactccttttcttattagagcagaattagccattctaagccctgcctctgcttcccatgtgaccttgggcatgacgctacctcttggggccccagctctctcatctgcacagtgaggaggactggttgagatgacccccttggcttccttccatccctgctggagaaatgtgattccattcttgtccctaactgctgtgggacttttgaggtcagccacctccttattcttgtcttcagcttctccttgtgaaaatggtgcactcatctacttgtgggccaggtaagtgccccagaagaacctgtctccccacgcttgcccatatattgtgatggggacgtattttggagattccttgctgacctactcacaagctagtagtgttgccatggcagccccttccactgcagtagctactttttgaatgtgctcggtcacagtgggtgaggtgggcaaagcgggcccctggggtcctcagcaatcatgtccagggtcctggatgtagctccatgttcggtatcaggaacacggcattctaagagcctcacttccttggccttacctcttgcaactctgtcctatttgatgaaaacagaatacacaaaaacccaggtgtatggagtagcctgaggacaggcttatattccctttagggagatcttctgtggataaaaaatcattagtggattttagcagagcactggtgacccaagttagcagcactcagatttcaactaatctaccccagcttcctaatttagtgctcatggggaaacctagagaggggaggaagaggcttagggccccagcaagtctacagatcctcaggatgcctggttccctgcagcaggccctggctccctgcagcaggcccctgcagggtcctgatggcccacttcccacctggcacacctagcatagctgtgtgctggctctccagtagtttggctgcccctttgggccagatgtcccagtgggccctgctttaaggatacttcatttgcaaaacagaactcttaaagggaattattaatcttttcagaaaagaactcactggcattttgggaccagatagatggctagctagctgccttagggctcttaggcaccagtggagggagtgggctctgactggctgtcttctctgccttcagggtagaggccaggactcctctacctagcatcccagtccttcatgcctccctgtttctctacttttccaactagactcacagtctctgtgctgcagtctgactaaactacttgcagttaattcctccaacttgtcttctctctcggttttgggcctttgcaatgccttttgcaggactctacttcctggggtcctgtctctgtgccttcctcctggaaggcatccctaagaacaccctcgtgtgggggttggggacctcccctggattcccggtcctgactgatcctttgtatataattgttcgcagccttgtctcccagccatatctgggataggcagtccaggagcagaactcagcctctagcagatgcccaagaagcagaggagaggcagggtctagaagctcctctcctggtgtggagcctggcgtgtaaagggtacttagaaagcactgatatggatgttagtgtttaggttccacccttctctctcccttcctctggagctttccatcattgccccaacattaaccagcctctagctggagaagacctttccctcctgattcctcagaaagctctgcttgaccctccgtcatagcacaggtcagtcagcggtgggtggacttttttctgtctttatctaggccctgtttattcatcacagtcccctcaagcattcagtcattcagcaaacattgatcgagcaccttccctgcgcctgaccctgtgcggagcatcagggcccagatgaatgagacatcattcacacacataccttttcccataatgagaaagggctgagtacaggggtgagatgggacaggcagggatgtggtcagtccaacctgggtggaggagaaggaagactttccagagaaagggtcaacaggttggtctctggcaggccagtgctcagtgtctggtggatgcctggtaagtgtgtgctaaaagactgaccaaactagacttggaagcaatagaactctacctgggagcactgcagtgaggtcagagagtgtggggagacttcctagagggaaggagtctctggctgaccacatagtgaggcaccaagtggagacagcttcctgtgtgaggcttgcgggagcccagccctagcctgggattctaatattagcgggcatcaccctccagagatggcagctttgccatgactggcctctcatcatcatgtatgtggactcccgctgaaaggtacctgcctggaggagcctggaagagagttcaccttcagccttgatgaagtggcatctctttggcacttggcctgacttcctagacctccctggggctggaagagcctgccaggggtcagtatgtactgaccctcactctgctacctcttctcataatacacagtctgttaccctgcacctctttaaaaactgtttgtgctctctgtctttgtgcaacttgtcctcagccctttgggggtaacttgggagtgactttctcactcacctagacccaggcagacattaggtccagatgggcccaggtgtgacatccttggggttggggatatgggcagggtgaccccccctgcctcaaggagcccaagaggctgttcacacctcttttagctggcatctttctggctctcttacattcataccagacattctggcccttttccataagttatttagattccttatgacaatcctggattaaagctaaggaggacactgagtcccagggagggggagtgacttgcaagatctcattgcaggtaagaatcagagccagggtttgaatcctaagtcagcctgtcgcctacgcctctattcctaggcagggcaggcattattttacccatcaaacaggagaggacaccgaggcttacttggtaattaaccagcattcatacagatctttactttttatgaagctcttggctacaaattatctcatttagttcccacaacaatctggtgaggtaggtattagccccactgtatagatgaggaagctgaagcttgtataggaagtgactcattcagtccacttcctacgagttagaggccaggttctcttgactctcggccccgttctctgcaccgtttccaggctggcatgtcccctgccagatgccagtatggaggtgaggtgggtagaggacacagtgtgggctgtccagaggcgtgagctgcccatattttctgtctactactgcttccccatgtgcgctcaggtcctcctctccataggctagggatcctcctgcccctctatctcattgccccaaattatttttcttcatagcgctcatcgctgcctgatgttatatcatacattaatacgtaagtgttttatttctccctcagcagaagttaagcatcctaacttaacttgagccagtctaacttgggtatcaggcctatagctgcctctgaggcaggacatcatctgctgcgctcactgctgtttccccagggccagtattagtgcttagtaccttgtatgtactctatgctttgggtcttagctctgtccccacccacctcccccaggaagccacctttgactactcattccaacttcttttttttttttttttttgagacggagtctcgctgtgtctcccaggctggagtgcagtggcgtgatctcggctcactgcaagctccgcctcccgggttcacgccattctcccgcctcagcctcccaagtagctgagactacaggcgcccgccaccacgcccggctagttttttgtatttttagtagagacggggtttcaccatgttagccaggatagtctcgatctcctgacctcgtgatccacccacctcggcctcccaaagtgctgggattacaggcttgtaattacaccgcgcccggccccaacttctttattctcagcttctatttcagacagtcacacacccccctttctgggctcttgagtatttgagtctgcctcattagaactccctgcaaggctttgttccagcaatttcccccatccacagtgcccacttccctcctgtttgccccctagatcttcagggccctggtgaagcctcatgggctccttggagcctcctctatgctaccgtcactctgcgacctcttcttataacacacacctatggccatgcgcctctggaaaaacgctgcttgctcattatgtataccccctcccactctggagacaggaggagcaatgccagtagccaccgcttaattacctaacaaatgccacatgtgccctacatgttttaaaatttaatgttcccaacaatcctgtgaggtggggattatcaccctcatcctacagataaggaaaccaaagctagagttaggtgacttgcctgaggtcacagagccaggcaggggcagagctggcccagggccctctttctcagatttagggagttgggggtcagacactgctgccctcaggcatgtgagaagaagcccagaacacttgggtttcatcagccccgaggtgtggccttcctggtcactttgatatcagatattgggcaaggaggtgctcatagacacccttcaacaccccagccctgggctgggccctgggtctgagagctacttgaaagcacgtgggctggtgggggcagggggtggaatccagtctcaccagaacgtctacatgagactctgggcatgatatgggcggaggaggtagctctccattgccaggatgtgttcctgaagtctaggtgtgggctggcttgtttaatggggccagccctcaacagcgtagcattgtagagatgatgagggactgggagcctgaataccctccttaagtcctggctgccacaccctgacctcaagcaagtgattttgcctctttaggcttcacctcacgtcaatttccttctctgtgaaacgggattgccagttctccccttgcctatcttcccagagagtgctgtgggacggtgaagccccacataggcgcgggagaaggggattgctttccgggtggtaaaagagctgctccgggcctcgctggcagctctacttcctgtgccttccccaaagataggagcaagtgtgtaaagcaagtgctgcctgggagcagctatttgagtcgtctattgggaatcttcccctacagcctgtctcatgtccccccatgaaacagagacgtctgtaggtagcagggttgtgttcccttcataggtggagaaacttgtacctaggaagggcaaaagacgctcatcccccatctctggggtcagtcctcagtgatggggctggcttggcctcctgccagacagtccagtctaacttgggcatccaggcctatagttgcctctgaggctgctctggatttgcttatggatttgctcagctatgcagtaaacctctatggctcctcttaccacagatgaatcaggtaccaagtcctggcacccatgagtcactggcagtgggatggccaaataaagtgacattggtgctgtgctgtgggagtgtgcagagagagtgcaggtgtggtgaggggcagattggctggatgctgaggctccttggcagccccacccaggagtcaggaacagtcaggttgggtgtgaagatggtggcatgcggtggcatctgattgcagcatcggcatccccaccagcttctgctggactcctcccagccacagctggggcagaggaagtactgacagccaggtggcaaggactggcagtgttttgcgggtgcccaactgaaccctcacttccatctgtgtgagcaatggtaccagaactatggcaagcaggtaagctccaggtcccaaataccctgctaggtccttaggagggtggatgccggagatcacaaacttcaccctccttacccccgtttcacagatgaggaaactgaagcccagagaggtgaggagacttagcatggtagttggtggcagagctgggactagaaccccaagtcctgctgccactttacctgctgtagaagatgcgtgctcctgacccacccctctgaaggaaaacagatcatccatttctccccttcccctcccagctccccaccactgccccctgctttgttttggggagcagagagaaggaacttggggacacacagcatcggagcagacgcaggcctggaggttgggcctgaattgagttcagctctgccagcccctggctgagtgaccttgacccagtatcaccatcaaaatagggccaaactcacaggagtccaagtgcctgtgcaagggcatggagggtcccaaagctttatgggcctcttgtgcatcatacctgtcactcagccctgcctggagggaaccccaggggcctgaagagtggccagagcacccccttggggcgggccctgacagggcattggggatccagatatggatcagacccagacctggcccttgggcagtttccagtgtgatgcagaatcagcttgtaatcagcagttactacaaggccagggactgtaggagccctgaggatgactctcttttgtttctccattgtgccggtctgactttatcttcaaatagattatctccttggccgtcaagatggcccctggtaattccaggcctgcatagaccttagtgtttatcatcccagagaaggaaagtccttctctttccaaaggcttcctggaagactgctgccttatcaccatctctgggttttgaaggatgtgttgctttatctcattatcagagaatcatcaagtgagtaaagcagggaagggcctctgccaagaatatttcttaggtggactgggggctcccactggcccgggattcagcatccatgtccaggccagctcccaggccacggctccatggtcaactaggttgggattgcctgagagggcctgggcctgagaaatgcagagatgcagtcctcccagcttccctctccaggagcctcccaactcttaacccccacggaagcacttgccatttggtatttgggacctagagctcaccaccttgcagcatcccagtacagttgctcaggcagatgggaagtgagggttcacttggtagactgcatttcccacttgttggcagagtgagctgtgggcggtagttggggctggataaggcagggtgagaactgaaccagcagtgtgtgaaaaccctgagctcagacccaccttgctgcagtccctcagtttccagtctgtataatggggtgagggttgaacaagatggtgtgtgtttcctgtgctatgactacctgattttaagacacctaataagcttagcagaggtatttggattaggcacgacgaaaaatttttaggtcttctcagttgtttcagttggggatatgtcatcagtgaaatttctatactcctcctccaagctgcatgggggctggccctggtgccaaggtagggagctagataagctgacatccagtgtgcctcttccctaagcacccctcaaaccactggcttcagggacctgtctgcaacgggaagcagtcagccacgagaaggcatgctttccttttttttcttgctgaatagaaggtggtggcacccagtgctgtgtctcacccctacctgagtgtttggactgaagtatttatggtggtgtttctcagacttaatcacctggggatcttgttaaaatgcagattttgattcagtaaatccagtctggagcccgaggtcctacatttctaacccgctcacaggtgatgctgatgctgctgttcccagaccacactttaagtaggaaagtgctagagtacattttgtcttctctctagccagggcatccagcctgcctcagatggagcaggaactcacctgtcacttaaccagcccccggtggctgtggctcctgcttcgcttcatccagcacgactcaggaggtagagccagctgctggaagatgacttgtccagccccagcccttggatcaagggctcaagcctgtgcttggacttcacttccctcccttatatactcacccaaacctgtccccacttgcaggtgaaggtgaagggttatgagaccctcaaggataagcatgtgatgaactcatctgtccaggccccactgctgggcaggttgatcaggccctgagcatgaccctcccactgtgtcctgtgtacagagcctttgcactcagagctgctctggggaaagggaaggtcctctaagcagggtcaggaatgctgggtttcagtcctggctctgccgcctactgcctgagtagccctgggtcagtcagtgcctgtctctggtccccagtctccctggctgtccaattaggctatactggatgaccccagagggccctcaggctccaggatgggttgctgggcaagtctggaggtgggaaagtcctatgaaggtaggatttttataaagggggtgaaggagcaattatgaggcagacctctggaatggttctatggcccagcctctttatttgtttttgtgagttcacatcctgctgcctgcacctcagttatgcctgtggtgttattagatgctactgaacacccagtttgtgcaccgaggatatggcagtaaaccctgcgagcttgcctggggtcacatagtgagtagaaccaaagtctgaacctaggtttgactcttctgctaaactaagccccttccctctgatgcatcacaccagggaaaggggtcatcttgaggcctagcatttccttccttcctcctaaaagtcaaagcagttgttaactttcagctgataaaatctggcctttcacagagcagatggtatgaaggaatgtttgacgggcacacagtaggtgcttggtgaagatgtgtcgagcaaagggcatgtagtgggggctcagcaaagaggggttcgaggtggcccacttcttcagctgctggaaggaatggggtatgggtgaggaactttcatccatgctcttccccagtgctgtctctcctgcagtcaccaggcttcctgtccccactgcccatcagctgctggagtccagggcgtcatcctaggggcaccaagccaattaagtgagcacatctcgtcctaagttccaggcttggcacttgcttgatagcgagcataattacagccctcagtgtccttcaggctgcctgaagctcactggccactgggccctttggggaagcaaaggctgtcaccttattcctttctgggctccacactttgggcactgagatgaggatgaacatgtacatctctctgaaagtggtagtggtgtggggaatcagtggtgttgggggtgggggcaagagggttcagctccttggagaaggggtattaatctgggacatacagaaggccgagcagggattggggatgctcaaagtacacttggagaaaaaaaacattggaaattggatgttgaacctctgtccttggcctcacagacagatagcaaagtttaaatatttgtactagatccagataaaggacaggagtttgactgaggtggaggggatggaagaaaactggcaattatgagagacttcccaaggcctagcccctggattagcctctttagatacttcatgtggtctccaaaatgaccccctgagtgcgataccattcccattgtgtatctgtagaaaccagggcacaggggagcatgcagacagcctagagttacaaagccatggggtggagggctaagatctgaacctaggtctgtctgattctatagctgatggtcttctcacatctagaaaagttcctgtgggaggtgaggtttgtactggtgaccctgtgactggagggaagggtgacagtggactgacatcttccctctgctgtaggcactggatccagcatcctctccgccctccaggacctcttctccgtcacctggctcaataggtccaaggtggaaaagcagctacaggtcatctcagtgctccagtgggtcctgtccttccttgtactgggtaagctgggccttacagggggggcgggtgggcaggcagagtccattccccaacagaggttagagtaggagccctgctctgcaggggtgagggaataagagtaagtcttacacacgctgccccccccagcacatttccacatctacctttgggtcccagatcaagtgctctacccctcagcatgcatgaggattcagcgagattcggtgggaggtggtgtgatagttcccatttacagatgggaaacctcaagtattagagaaggtaggtaacttgcccaaggtcacacagatttgaatccctgtctataggacccccaaagcctgtgcctttcccacagtgccaccctgcccaccaacagacattttctagcaggtatgttactttgccttaaggtagtttggtgccatgtttaagtactgaatctcctgcaaacaagctctgtgaccttacacagattatttgaactctctgagtgttagtttcctcattttgaatgtgaggaaagtgcttgcttcacatggcttttgtgaggattgaagataagaaatgagagcacctggcgcagggcctggtcatgatgggcccccattacatgggagtcatcaggaggtgccctcagaccccactcctagcccacacccatccttagctgagcatattccccaggtgcttcccgaggcctgctccctgctgtctctcagcacagcccacatcagtgctttggttgctttttctgcaggtctggcaagataccctcactccttaggttgccatccaggccagaggcaggacaatatgattgtctgaggggagggaagaggccccttgtttttccccagacccctgtgctctcagcatagcaggtagcttcctcagcacgtcaaggcagatgaacctgctccagagcatcacagagtgcattctagcacctgtgagccagtccctctgggcgacccactcttcgggactgtataggctggtaggggatcatcaggacttaccatgtcagtgctgagcagctgtccttcagacagatgcatggggtgccctgaaactcagaccatgtttgcagagccaagggatagaacttcacaggtgagaaaatggaaatttgcagaggttcatcaactacctgctaccgtgaagctcattaaatggcagagttgggatttgagcagaaactcagtgcattccccaggaatcccacattactggaagcccagaattagtgaactggggctgaaacagccagtcttcacctttaggcccaagaacgggctttgaggaggggatccatgaacccttaaaattatatgcaagattatatatgacagtatgtgcacatttttctagggagaagggccatactgtcctcaaagtcttacagggacatgcagcctcgagaagccaaacactggttggaagaactgagcaaactaaacaggctcccttaggactcagaccctaacatggcttgcatttggccacttactagaatcccagagtagcgagcacagtgtgaccccttcttactcaaaaaggaagtggaggcctgcttggggtcacatgagaagaaagtactgggaccaggacaagaacccagggactccagcctcccagaccccctgcctagtctgctagaccagctccctttgttccctgttgcacccaaaagccaccactatccctgtcttagtgggtctgggcctggctggtagggagctgagcagcttgtagaacaccagctcacgcagctggtgatggggactggccctaggctgtaggttaataattgatcagacccaaccacagcccagaaaccggcccagcatcttctcaacacccttgcctggcctcgcctcgcataggtgggagcctggcctggttggacaggcagatctcctgagctactgctaattaccaccctcagcagccccagccactccctccctctgcctctcaaacctgctggcagaagctcacctggcaagcaaagaccatggtagccctgttggtctctccctggaccagagatttttcaccactttgtgccatggaaccctctggcattctgatgaggcctatgacctttcttagtgttttagagtatttaatacaaggtgcattggatttcaaaggaaactactgataataaaatataaatatctacacattaaaaaagttgattagacatgtagtaacaggtgcctttttattactgtaaataaaacgatctagtagcaagtgtaaaactgctacaaagttatgtgaaaatacctttgttatttatttgtgtcataaatactgctgataattctgtgatttattacattggtaagtgaaggaaatgccaaatttccataagagataagtgaaaatttagatgtcatttgtttccccattcaagtccatggatattgtgtgtcaggctaagtaagttcaaacatcatgtttaattttcccaataccctgtaaggaaattaagacttaggaatggggcttggccagcaagtggcaggactaaggctctaggcctgtttggtcccagagtccatgctcttcaccaggacacactgctgccttccctgccattgatcatccacagactgccctgcaccacaggccgcagggctccagaattttgtatcacaagtgtctttgcaggcaccatgatgtgcagaaagtgggtgatgtgtgaaagcggtcctgagccttccttgtgtggggcaagcagggccttctaagcttctcatgagctcagcaacagtggtttttactgcagccccatgacctaagagcatggaaccagagcctgttgttcagaggacaaggattaggctctgagaaaggaaggtcatttggtggatttagttcatccttttgctcttcctgtgtttggtttctggggctggagagattaatgtcacctggtttctgctctcaaggagctcaggggctaaagagctgtctgctagagggagtctaatgagggaggcagatgacgaaagggatggtaagtggtttgagagagagttgtgtacacataggggaggggaggaagcccccagctgagaaaggccaggctagaattcagtctctggataccccatcaggcctcttcttctccatccaggctgcctcagcagcagagtaaggacaagttggtagggatacccaccttcccagagagaccagccctctaagcagtggggcctggagctcattacccctctggtcccattacccctcaagagagttagaggtttctggaagctaggtttccagggtgctcagaccatagcctaaacctcatggttcctgtctggcccacctggagcatccacctagaggatgccactagaggagcctggatgcctatggagtctggggggctagagtcatcccttttcaggcctaagaaagggaatcaggcagactgctgaacagtaagtatgactttgtaggcagcttttagacatagctattcaccaagctaccataagcttttcacagtttgcttttaacaggctcttgtaggctgcacatgcttccctagaaacttgtcttcccttctgcgatgtcatactcctaagctggtcctgacaaattggacatctcgtcactctgtgttcactgcccctcccaacaagagagttgtaccctgtttttagctaccctggggagaggctggcttaggagtctagaacagggctagactggggggcaacaaggggctaccatttccctccccataggctcatggagagtctacatccagccttatcttctcccatgggaaaccagaggaggctcagcatggtgagaagagagcatgacatccagagctaggcagcctacagcacctgggaccaccaggggatgggcacacacagcaagggttggcctcccttctggggcagtggaaaaagtcctagaaggaggccatgcttctcccaccaaacatgagtacctgctgcccttgcccttgtgccgaataccaggcaccaaagaagatgcctccccgcccagtgtggggaatttacaggcaagagatgatatgtagatagtatgatattggggaatacttcttgaagagctgaggtctgagataggccttaaaggttgggtaaaaaatggaaagagagaagccctgctgagggcagctagtggcaagccatgaaataaagcaggcatggcacaaactctcctttctttctgtgccaggctaggttagtctcttttatggcctacaggcccagaatatggtgaccaatggaagccagcctccaggcaagtcttccaagtgtgctgttagggttttttttaatacttttttgagatagggattccctctgttgcccaggttgcagtgtagtgacacgatcatggctcaccgcagcttcaaactcctggcttaaggagtcttcccatctcagcctccagagtagctgggactacaggcacatgccaccttgcccagctaatttttaaaatttttttgtagagaaggggtctcgctatgttgcccaggctggtcttgaacttctgagctcaagcagtccaccacctcagcctcccaaagtgctgggattacaggtgtgagccactatgcctggctgctgaggtttttgaagacggggaggctgatgggctctgcgctttgacctgggacttcctggactgccattatgttggaagggagccagccctcctcctgggcaagcatctcctctctggtccctccagtgatggtctgggactctggtgaatttctaaagcctaatgcagagaatggactgtagagtcagacctgtgtttgaatcctggctctgccactgtcctgctgggtgaccttgggcaagttatctcccccttgaacctcagtgtttttatctctaaaatggggcaaagtcaccctgcctcacacttgagacagtggctcagcccaagtcttgagatgcagaggcactgggtatgtgttccctcccctcatccacagtgtctgggctgggtgctggcacgggggcacacacaaggaggggacagtaagaacagcttcacaagaagctgaagcctatctcctttggtgttcctgcacagataacatggagtccatgggcccctcaatgcccggacagtccatcagaatctgggagatgaggctcgtcttgtcccaggaatctgctcctccctgggctgagcattcctgtagctatttctcagggtttgtgggccctatgcccatggccctgggtgtgcctagcttagtgccacagtaaacactcattccatccaccatggccctgaggggagatgaagcccagtaggacatgacctgtgaccatttgcccccgcaggagtggcctgcagtgccatcctcatgtacatattctgcaccgattgctggctcatcgctgtgctctacttcacttggctggtgtttgactggaacacacccaagaagggtaagtgcaaggcctcccttgccccacccctcattctaggtatgctctcccccctgcacaagctgaagggcctcatcctgagtgctgtctcttttaacacccactttgtgaaaagcattggactagtcctttggggggaggttaaaagcccctcagaaggcactgttctggtcctcacgagttcacactcagtcgagggtttgcataacatgagggaatgaatgtgaaaaggggcccgataggaagggggcgaagatgctccatggggtgatggtcacccgcttggatttcacaccagccctgtcctgtctgccttgcccaaatgtacccccacccccactaactctgtattttattccctggaaggtggcaggaggtcacagtgggtccgaaactgggctgtgtggcgctactttcgagactactttcccatccaggtaaagtgctgtgagtgttgtcttttgagggtgggaatgggtgggaaatctgaactcgggccttaacccacccacagggaagcaagtttagaccaagttggtctctgggtttccttcctactgtgtctagctgtgctggggacctcactgctcttctgagtatccatcgtctttgggccagccctgaggtcctgacagggaaatgtggctcagtttggctttcattgtcacctctgtctggtccctgcctggtctgcaagctgggctggtgaggcacagtcatctggccctgatgcatgtgggcgattgggcgatgctggtgaattgaggataactctggcaggatcctgaaggttttccccacaggggaaagacctgtctggctagctcactcaacaccccagccccagcacaccctagttgctgagtctccccgagaaggtaggggtgctgaagagtggaggcagcgtgtgaatgtgaaagtgttctgtgcggggtgcagggtggtgtatatttgctgttgtgagtcagtgactgagatcctggtgtgctgcctgggggcagtggctgggtaaccctgcatccttcactgcattcagtatgttgagggtggcagggccagctccttctgctcatccttagcctaagcccagtcttcccaggaccttactgttcctcagggtcagagttccttctccttttcctgaccccatctctctgactgcagaaaatttgaagctgcttttgttgggagaaagttggatcataggacccaaccctctcattttggaggtaaagaaactgagcaggtaaagatgggcaggacttgtccaggctgcatagtctagtatgatggcaacattgcaaccaccatccaggcttattgaattcgggacccaggttcttttccactgatttcctactgcctgtttctctggagagattcaattcctggatttccccattggactgattccagcttcctgggtctccctctccccctttgctgctggagatctcagtttaaattcctgccctgtcactccattcattgacctgccaccattgctccctgtccagtgcagggctctgctgggcatggggacacaagtcagccctgcccttggggtgagctcactgtctaatgcatcctgatagactttgtcactttctaccatggggccatgggcagactttctcaagcctgctgagcctcatctgcaaaatggagctgtatgatgaaaagtgaaaaaaagctgtatgatgaaaaaaatgaaaagtgatcagttctggttgggtgtgagtgatgatagactgttctctctgctttctctctcacctcaggggccaggctccagtgttctctgttgccactgtggcctggtcctctggaagcctccaggaggccagtagccccatccacttggaacaggatgacctgatgaccgttggtcagaccttggacaggcaggtgtcctttgctatctccacccttccaaaagaaccaaaacaaacccctgtgtccttctcacatctctgttccaagaagtcaactgggagttggagccatagggcacatgcaacctggccctgtgagggctccctggggcactaggacaaaacccaaactgggcctgaggcaggctggggtgttgagcctcaacctggggcttaggctgggccctgcctctgtccctcagggcctcagtctccccttctgtgcagtcaggatttagccatagtgatctgacatcatgcctgacactctgtaggggtgtgtgtgaccctcctgtcccacccccttttcctggcctcttgccagtaatcatgtaatgaagatctgccattgtacccacccacccacctactcccttcctggtgggactctggtctttgccagcagaacagctcatctggcccagaatgtatcccttctgttggcacaggtggggttcatgtgttagcaatagccaccgagaccaccagccacctggaagaggagcagacagtgccccaggtcacctctccccaaggtgtaggcagaatgcttggagaggagactaggaaagactctctctaagcttagaatcacctgtccatctgcctcatttcactgataggcttactgaggcacagagacgagggactatcccaaggtcacaaagcttaagtagtagcaggactagtgtaggaaccaggactgtctgctttgaggcccatggtcttactcctgtgttactttcaccatcactgtgctgtgctgtgtaaacttaagcaagcctttgctcttctgtgggtctgaactttttcctctatgcactgctgtggtgggacaagcctatctgagcacctttcctcttgtgggaggcagggtataaagagtgacttgataggaatgtttcccagactgacattagccagcaggcttggcctgggcatcgtgttgggctaggactttgccactggaaacaggcagcaagaggacacaagagcaggcgtgtcaacagagccttcattggcggtatccttcccctccctccagaacagacattctcttcagccctgcgggaggggagtgtgacatgaaaatagatcagagctggtcagatgcctacattcttttgggtcctacagcaagggcattgacttgcactgtgtcccaaagcacctcattcaaacaaatgtcccatcagagccttgaggagggaggagatgatttaaagagccacctggggcccactgggtgacatgtcttcatccagcagcccagggaaaagtgcagtgactggcctgctgcagacatgcaggataatttgctgtgacctccacaggggaagtgcagttcccttctctaggcctcagcttccctcctgtcatccaaggaatggcttagacctttcagagctctgccagcccatgctgtgttgtgtgttcctggttatcaaggcccgatgggaaggtgggggtagccataggaaggggacaaaaagatgctgcatgccgtgatggtcacctgctggggtaactatcccaggcctggccatcagctcaggagcaagtttccaagtttcccacccggtattggctgccccagctcttccctcaatgcctgcctgcctttttcatcaaaactagcacaaggagcctttttttttttttttttttgagacggagtcttgctctgtcgcccaggctggagtgcagtggccgaatctcagctcactgcaagctccgcctcccgggtttacgccattctcctgcctcagcctgtgaagtagctgggactacattagctgggactacaggcgcccgccacctcgcccagctagttttttttgtattttttagtagagacggggtttcaccatgttagccaggatggtcttgatctcctgaccttgtgatccgcccatcttggcctcccaaagtgctgggattacaggcttgagccaccgtgcccggcccacaaggagctttttaactccagcttcactgagagctaatttggtaggcagacctgcttgttaggaggcgaaacattggaacagcaatcctacagagctcacataaacgagattttgagatctgctcactgtcccaagccccattagccagccatggattagactgctgctgtttcccatttatttggggagtagctgagagttggttgggttttggagcaactttaatctgtttgcctagggcaaaacgggagaaagagcatcagtcccccaagcggtggggatgagagggagtcttgctcacatttgcatagactggcagcgtcagagctgagaatggtgccagccacccttttccatcctctctgtcacctaaagattgggatttcaattttccaaggtcaccaccagcatcctctcccccagagctgcacacaaggtccttcaactctgccaggaggctcccaaatctagagtcacagaaaacctgggctcttgacgttctgctggtggccagtgactctgcttccaggtggcaccagttcagggaaggggcactttgcagcactcaggtgggagtgtcattgatatcacttctcttgaggcagggcagccaaaaagaccaacgtgttcattccttgttatccaggaattgtatttctagaagtttgtttcacaaaaacaatcagatatgtggacaaagataaggtatttattgaagcattacttctaagagggaaattttggaagtttttaaaatgtccatcaaacagggtttgagtcggtgctgttacatgtaggagagctgtgctgtagaatacgaatgcagccacgagaagacatggaactgagggattttgataaggacagatagctatatgtttggtggaaaatgatataaaaatgatatcaacccatataacctcaattttgtggattttgaaaaagagcatgtatatttttgagtagaaaaaggactcagtgagattgtttcatctggatggaaatatgaatttttttaaattttctttttgctttcctatatttgtaaaattctttaggagtttctttattttctttccctctgctttcttttcttctcctttatttccctgtcctttcctttcctttcctttcttttcctttcctttcctttcctccccttttcctttcctttcctttcctttcctttcctttcctttcctttcctttcctttcctttcctttcctttcctttcctttcctttcctttcctttcctttcctttcctttcctttcctttcctccttcctttcttcctttccttctttcctttcttcttactctgtcactcaggcttgactgcagtggctcaatcttggtttactacagcctctgcctcctgggctcaagccatctttccacctcagcctcctgagtagctgggaccacaggtgtgtgccactatgcccagttaatttctgtatttttgtagagatgagggtttcaccatgttgcccaggctggtctcaaactcctgagctgaagcagtcctcccaccttggcctcccaaagtgttgggataataggcatgagccaccatgcctggccctattatttttctaatcagaataaaagtaatgtttttatgagcagaatacccttactcattgtctctctcagcctcctccacccccatcttgttccttgtaacgcagggtaggtgtcacaggctctgcctctcatggcttagggtttagggacactgcatcacccacccctccaagcaccagccccagggcagcgggtgggccctgaggaagccagtcatcgtttggagcagcccagtgcccttagtaccacaggtcaggttctcagctgctacagccttacaactgacctctatcctaggctggctggcacagggctgtcgcttgtccttcctgcctcagaacctgagctgagcccagctgactgtgggaaagtttccatttgagccagccagtgtcccttttccaggccaggggagtaggaggtgggctgcctgtctcattctgtgaactgtggaggagcccacagagcacagggccaagtaaaccttacctccaaggagctcatagtttggagagactgacagtgggggcagagcttgcagccaaggccctggttgccaaactcagaaacttggaccttactcatatgaagccagacaccctttccagtctgagagtgacaagggttggatttgagttttatttttttttttttttttttttttttttttttttttttgagacggagtctcgcgctgtcacccaggctggagtgcagtggccggatctcagctcactgcaagctccgcctcccaggttcacgccattctcctgcctcagcctcccgagtagctgggactacaggcgcccgccaccgcgcccggctagttttttgtattttttagtagagacggggtttcaccgtgttaaccaggatggtctcgatctcccgacctcgtgatccgcccgtctcggcctcccaaagtgctgggattacaggcttgagccaccgcgcccggcctggatttgagttttagaataatcactctggctgtggcgaagaggatgggcccagagggagggaatgccggaggctggcagagtgcaaagaagaactgtgtgcttggctggggactgagaggaacaagggcaaacattacccaccccttcccagagagccatagcgcaaatggtgactgcccaacaccagcactgtagccctggggatgagagtctgaggtcaggtgtggagagtcattgcagcagccctcaggcccatggaggcccaggggaaatgacacatccagtccctccctaccctctgggtatgccctgggatccctctcccagccagtttcctctgacccaaggtcatccttgcagctggtgaagacacacaacctgctgaccaccaggaactatatctttggataccacccccatggcatcatgggcctgggtgccttctgcaacttcagcacagaggccacagaagtgagcaagaagttcccaggcatacggccttacctggctacactggcgggcaacttccgattgcctgtgttgagggagtacctgatgtctggaggtgagaatccaccccctgcttgctcctgctgggcactgttgtcaaggcctgagcctctccatcgagcagggtgacacagggagccaacacaccattccttggtgctgggcctgcattgggagatgcgacctgctgcagacatggtgggtcagggctgaggaggagagctgtccatatggtcttcagaattcaactcggataacaacttccctaggaagccttctttgacccccttttccagggatccccagcccttgtgttgccctctatacaatctgattgttgtccatggcactgtaattgtccatccacctgggacttcccaccagactgatgcattgggatccccaacaccttgcactgacttggcaggattagggcccagggaatgtttgccaaatgcatgagttcccaaaacaaccttgtatcattagctgcattttacagatgaggaaactgaggctcagaaaaatgaatagcttacacagaaccagacaactccaaagggactgggctaggtctggggccaagaccagggttctttgtgttttacacgtgactgtgtgctggggatggggagtggatccatgggcaaccctgactgtgcgtccttccctccccccaggtatctgccctgtcaaccgggacaccatagactatttgctttcaaagaatgggagtggcaatgctatcatcatcgtggtggggggtgcggctgagtctctgagctccatgcctggcaagaatgcagtcaccctgcggaaccgcaagggctttgtgaaactggccctgcgccatgggtgagtacacacccactcactccctccagtgtccctcagcacagggcagcagactccttggcccctgaagacaggacccagaccccaggaaggcatagaagggagtcagtcattctgttggggaggggatgatgttggagcccagactgcacagtgtgggccaagtttgcccatgtgtgtctgggtgggcacagatgcaacctgttgcctgggggcccttgcaggtgggccaagagtccaggcttatatgccggactggaccacctggggccagaatacatcattttgctgggagaccaggaggtcaggaaggagggtggcatggaatgtgactgggggacagcagctcttttctctgtcccctgggggccttacctcaggctttggaagaagaggctgcccttcaggctcagccctgggccagcccctggggacccattcaaattggacccagtccctgccttcagggagcaccaagggtagggaagggtggaggtacagacagtgacaacacagtgtgctgagactgtgacacaatggtgagtccagggctgagagagacctgggttggctgggggacagggagaacttcctggcagaggcaggccctgcaggaggaggtggaaaacaggcattccagagcaggatgctcagccttccctttgcctggggggcccagagctctgtatgctccccagtcactagcagtggggcagaaggcccatcagaacctggtagagaggggtcatgtgaacttgggacactccaggtgattctggtatacccagttggagggggacacttggccagtgtccagggcctctaggctgacagaaactgaagccagtaattagggtatgacagaccctggcctctcccttccagagccgacctggttcccatgtactcctttggagagaatgaagtgtacaagcaggtgatcttcgaggagggctcctggggccgatgggtccagaagaagttccagaaatacattggtttcgccccatgcatcttccatggccgaggcctcttctcctccgacacctgggggctggtgccctactccaagcccatcaccactgttggtaagcccctagcctgctgaccaagggctgtcctgaacacagggtgccacacagctagtcagcagtagagacgggattccagtgcaggccacctggctctgatggccatgcccttagccatgaggactttgaagtgttgggtgctgatgggcttggtcagagagggtagtagtaggggtcggggattgagcctatgtgatgaaccaagctctgtgatgggtaaggaaagaaaatctgcagtctccgggtttgcagcacctactagtctatcagggaagactattacagcaaggactggtgggggaatgtgatgaggatgggcaggtgctctagggagtcctagcggaccccagggaggaggtaactcttgcactgctaactgataggaattatctagcaaaatagaggaagaagagaatttttatcagaaacaatagcctaagtgaagttcagaaacaagattgtgtagtttttttgaagaacagaaagaaaaaccttaatatgactgcagcatagacctgtcagaagagtggaaaacagtgattgcacttggccctcatctgtgttgttttgggtgcatttgggattgtttagaggattctaaagaattacctatagtaggtgtgtgtgtatgtgttaatggatcccccaggagcacatgggcccttggcagtggacttgaggggccaaagctcataaagatcctttgtgctcctaggccatttgtcctgccttgtacttttagatagagacaaagcaacagggaggcagcaggaacatttccatgcacaggtgtggctggggaggggctgagtcctgtgggcaatgtgaaggaatttgctcttcaccttgagaatggagagctaccagagagtgtttgggaggggaagttcagatttgcattttaaaatgatccttggagctgctggatggaagatgggttagaaaaatggaagccacaagaccagcccagaggctgttttggtagccagtggcttggaccaagggagtagcagtggagatggaagagatgtgcatgatctgggaaaaatttcagaaatagcattgacaggacataggaatggattgggtatggagatgcagcaggataagaaaataaagcaacacacagatcataaatgctggtcttctccctcctctcctgcccttaaccacactttttattttttattttttatttttgagacagggtttcattctgtcatccaggctggagtgcagtggcgcgatctcagctcactgtaacctctgcctcccagtctcaagcgatcctcctacctcagcctcctgagtagctggtgcaccaccacgcccagctaagtttttgtatttttttaagtagagacgattttcaccatgttgcccaggctggtcttgaactcatgagctcaagcaatctgcgggtctttgcctcccacagtgctgggattacaggcgtgagccaccatgcctggcctacactttttattttttattttttttattttttatttttttgagacggagtctcgctctgtcgcccagactggagtgcagtggcgcgatctcggctcactgcaagctccgcctcccgggttcacgccattctcctgcctcagcctccggagtagctgggactacaggcgcccgccaccacgcccggctaatttctttttgtatttttagtagagacggggtttcaccgtgttagccaggatggtctcgatctcctgacctcgtgatccgcccgcctcggcctcccaaagtgctgggattacaggcttgagccaccgcgcccggccaaggcctacactttttaaagcatgtcacattcctcacagaatcctcagaaaagccctgtgaggaagaatccccatgtaacagaggaggaaactgagactcagagaggcaggaatggcttgcccagagcagagcaaaagcaaagatgtttacttgatcccctgactgtcatagaccctcctagcagaatgcagtgggttcaaccagtcttgatcccatctgcagcttagcacctgtgtggccttgggtgggtcccttcacatgctcctgggcctcagtcttttcatctgtaataggggacaaccagagatgcagcacataaagcnnnnnnnnnnnnnnnnnnnnccccaagctggagcatccaacccagcaagatatcgacctgtaccacaccatgtacatggaggccctggtgaagctcttcgacaagcacaagaccaagttcggcctcctggagactgaggtcctggaggtgaactgagccaggcttcggggccaactccttggaggaaccagttgcaaattgcttttatgctctgtaaatttggaagcgtcatgggtgtctgtgggttatttaaaagaaattataataattttgctaaaccattacaatgttaggtcttttttaagaaggaaaaagtcagtaattcaagctcttttacttccagtttgccctgttctaggtggtggctaaatctgggcctaatctgggtggctcagctaacctctattcttcccttcctgaagtgacagaggaaactcagtcttggcctggggaagaaggatcgccattagtgacttgggccagttagatgattcactttttgcccctagggatgagaggcaaaagccacttctcatacaagcccctctattgccactaccccacacttgtctagtcctgaaactgcaggaccagtttctctgccaaggggaggagttggagagcacggttgacctgttgtgtgaggacagtagtaggcatctggaatgctcctgtttgatctcccttctgtcacccactcctcacccccagtcactcacatcagagcctggactggcctccaggatgaggatgggggtggcaatgacaccgtgcaggggaaaggactgccccccatgcaccattgcagagaggatgccgccaccatgagctaggtggagtaactggtttttcttgggtggctgatgacatggatgcagcacagactcagccttggcctggagcacatacttgctggtggcctcagtttaccttccccacatcacagattctggatgtgaggaagaggtccctcttcagaaggggcctggccttctgagcagcagattagttccaaagcaggtggcccccgaacccaagcctcacttttctgtgccttcctgagggggttgggccagggaggaaacccaaccctctcctgtgtattctgttatctcttgatgagatcatagcaccatgtcagacttttgtatatgcctagaaaataaatgaaagtgagaatcctctatgagttattgctggggctgcatctgcatctgctgctgacacctgggggagactggggccccagctggctgccctctgagccctctagccccttgcacctttggcccacatgacactgctgtggtgtgttagttacctatcactgtgtaacaaactactttagagctcaatggtttccagcagcatctgttgtctcccagttccaagtcacgatttgaggcttggcttggtcctccactcagggtttctcacagggctgcagtcgtcttggagccaggctgaggaaggatccactcccaagcccattcctgcagttgtttgcaggattgacttcctcactggctgttgacagaggccactctcagttccttgccacatgggcctttccatggggtagctcatggcacaacagctgacttagcaagatgagccagtgagtggagtgaagtgtgtgagcaagacagaagtcccaggcccttacaacctaacctgggaagtgatatcctgtcacctttgccatattctgttcattaaatgaacattgctaggtccagctcccactggaggggaggggattacaccagggaatggatgccagggggcaggggtcattgggagccacttcacatggtgcctaccacatgtggtaaagggctcctgtccagctggagggcccttcagtggctgagctggaaggctccttatgggtcactcaagctgtgttccctgccaaaaaggcagaggcccggcctgctgtcaccctagtgatttcaagatgccacctcttttctaattcctttctgttcagtgaatactaggcacctgggaacccttcccagccgagaccaaaggacctcgttctaacttccttactgccagaactgtcctgcctgtccttgctgttcatccccctcaggtccaactcctctgtgctggaaactgagagagctacttgggagcagagacaaacactgagaacagctgaggatacacagggtagtcagagctgtgccagaagtcccaacctgcccgggggtgcctcatgaggaaagaacgcctgagctgggccttgaagggcggctgggagtcaccaggaaaggaag

SEQ ID NO: 4 - DNA, 17 bp, Artificial sequence
  Primer
ggcctcccggagactga

SEQ ID NO: 5 - DNA, 22 bp, Artificial sequence
  Primer
aagtgatttgcagctggttcct

SEQ ID NO: 6 - DNA, 24 bp, Artificial sequence
  Probe
aggtgaactgagccagccttcggg

SEQ ID NO: 7 - DNA, 18 bp, Artificial sequence
  Primer
aactggccctgcgtcatg

SEQ ID NO: 8 - DNA, 26 bp, Artificial sequence
  Primer
cttgtacacttcattctctccaaagg

SEQ ID NO: 9 - DNA, 14 bp, Artificial sequence
  Probe
ctgacctggttccc

SEQ ID NO: 10 - DNA, 19 bp, Artificial sequence
  Primer
actgggcgggcttcatatt

SEQ ID NO: 11 - DNA, 18 bp, Artificial sequence
  Primer
cccggagtaggcggctat

SEQ ID NO: 12 - DNA, 14 bp, Artificial sequence
  Probe
agccatgaagaccc

SEQ ID NO: 13 - DNA, 18 bp, Artificial sequence
  Primer
ccgcaagggctttgtgaa

SEQ ID NO: 14 - DNA, 23 bp, Artificial sequence
  Primer
ttctctccaaaggagtacatggg

SEQ ID NO: 15 - DNA, 19 bp, Artificial sequence
  Probe
cctgcgccatggagccgac

SEQ ID NO: 16 - DNA, 20 bp, Artificial sequence
  Synthetic oligonucleotide
tggatgggaaagtagtctcg

SEQ ID NO: 17 - DNA, 20 bp, Artificial sequence
  Synthetic oligonucleotide
ccagctggatgggaaagtag

SEQ ID NO: 18 - DNA, 20 bp, Artificial sequence
  Synthetic oligonucleotide
cttcaccagctggatgggaa

SEQ ID NO: 19 - DNA, 20 bp, Artificial sequence
  Synthetic oligonucleotide
tgtgtcttcaccagctggat

SEQ ID NO: 20 - DNA, 20 bp, Artificial sequence
  Synthetic oligonucleotide
ggttgtgtgtcttcaccagc

SEQ ID NO: 21 - DNA, 20 bp, Artificial sequence
  Synthetic oligonucleotide
cagcaggttgtgtgtcttca

SEQ ID NO: 22 - DNA, 20 bp, Artificial sequence
  Synthetic oligonucleotide
gtggtcagcaggttgtgtgt

SEQ ID NO: 23 - DNA, 20 bp, Artificial sequence
  Synthetic oligonucleotide
tcctggtggtcagcaggttg

SEQ ID NO: 24 - DNA, 20 bp, Artificial sequence
  Synthetic oligonucleotide
atagttcctggtggtcagca

SEQ ID NO: 25 - DNA, 20 bp, Artificial sequence
  Synthetic oligonucleotide
aagatatagttcctggtggt

SEQ ID NO: 26 - DNA, 20 bp, Artificial sequence
  Synthetic oligonucleotide
atccaaagatatagttcctg

SEQ ID NO: 27 - DNA, 20 bp, Artificial sequence
  Synthetic oligonucleotide
aaggcacccaggcccatgat

SEQ ID NO: 28 - DNA, 20 bp, Artificial sequence
  Synthetic oligonucleotide
cctccagacatcaggtactc

SEQ ID NO: 29 - DNA, 20 bp, Artificial sequence
  Synthetic oligonucleotide
ttgccaggcatggagctcag

SEQ ID NO: 30 - DNA, 20 bp, Artificial sequence
  Synthetic oligonucleotide
tggacccatcggccccagga

SEQ ID NO: 31 - DNA, 20 bp, Artificial sequence
  Synthetic oligonucleotide
tcttctggacccatcggccc

SEQ ID NO: 32 - DNA, 20 bp, Artificial sequence
  Synthetic oligonucleotide
tcttcaccagctggatggga

SEQ ID NO: 33 - DNA, 20 bp, Artificial sequence
  Synthetic oligonucleotide
ggtggtcagcaggttgtgtg

SEQ ID NO: 34 - DNA, 20 bp, Artificial sequence
  Synthetic oligonucleotide
tatccaaagatatagttcct

SEQ ID NO: 35 - DNA, 20 bp, Artificial sequence
  Synthetic oligonucleotide
caccagctggatgggaaagt

SEQ ID NO: 36 - DNA, 20 bp, Artificial sequence
  Synthetic oligonucleotide
gtgtgtcttcaccagctgga

SEQ ID NO: 37 - DNA, 20 bp, Artificial sequence
  Synthetic oligonucleotide
agaaggcacccaggcccatg

SEQ ID NO: 38 - DNA, 20 bp, Artificial sequence
  Synthetic oligonucleotide
cgcaggaccccggagtaggc

SEQ ID NO: 39 - DNA, 20 bp, Artificial sequence
  Synthetic oligonucleotide
aggttgtgtgtcttcaccag

SEQ ID NO: 40 - DNA, 20 bp, Artificial sequence
  Synthetic oligonucleotide
tcagcaggttgtgtgtcttc

SEQ ID NO: 41 - DNA, 20 bp, Artificial sequence
  Synthetic oligonucleotide
ttcctggtggtcagcaggtt

SEQ ID NO: 42 - DNA, 20 bp, Artificial sequence
  Synthetic oligonucleotide
tatagttcctggtggtcagc

SEQ ID NO: 43 - DNA, 20 bp, Artificial sequence
  Synthetic oligonucleotide
aaagatatagttcctggtgg

SEQ ID NO: 44 - DNA, 20 bp, Artificial sequence
  Synthetic oligonucleotide
gaaggcacccaggcccatga

SEQ ID NO: 45 - DNA, 20 bp, Artificial sequence
  Synthetic oligonucleotide
cttgccaggcatggagctca

SEQ ID NO: 46 - DNA, 20 bp, Artificial sequence
  Synthetic oligonucleotide
ttgtgtgtcttcaccagctg

SEQ ID NO: 47 - DNA, 20 bp, Artificial sequence
  Synthetic oligonucleotide
gcaggttgtgtgtcttcacc

SEQ ID NO: 48 - DNA, 20 bp, Artificial sequence
  Synthetic oligonucleotide
ggtcagcaggttgtgtgtct

SEQ ID NO: 49 - DNA, 20 bp, Artificial sequence
  Synthetic oligonucleotide
gatatagttcctggtggtca

SEQ ID NO: 50 - DNA, 20 bp, Artificial sequence
  Synthetic oligonucleotide
ctggatgggaaagtagtctc

SEQ ID NO: 51 - DNA, 20 bp, Artificial sequence
  Synthetic oligonucleotide
gctggatgggaaagtagtct

SEQ ID NO: 52 - DNA, 20 bp, Artificial sequence
  Synthetic oligonucleotide
agctggatgggaaagtagtc

SEQ ID NO: 53 - DNA, 20 bp, Artificial sequence
  Synthetic oligonucleotide
cagctggatgggaaagtagt

SEQ ID NO: 54 - DNA, 20 bp, Artificial sequence
  Synthetic oligonucleotide
accagctggatgggaaagta

SEQ ID NO: 55 - DNA, 20 bp, Artificial sequence
  Synthetic oligonucleotide
tcaccagctggatgggaaag

SEQ ID NO: 56 - DNA, 20 bp, Artificial sequence
  Synthetic oligonucleotide
ttcaccagctggatgggaaa

SEQ ID NO: 57 - DNA, 20 bp, Artificial sequence
  Synthetic oligonucleotide
gtcttcaccagctggatggg

SEQ ID NO: 58 - DNA, 20 bp, Artificial sequence
  Synthetic oligonucleotide
tgtcttcaccagctggatgg

SEQ ID NO: 59 - DNA, 20 bp, Artificial sequence
  Synthetic oligonucleotide
gtgtcttcaccagctggatg

SEQ ID NO: 60 - DNA, 20 bp, Artificial sequence
  Synthetic oligonucleotide
tgtgtgtcttcaccagctgg

SEQ ID NO: 61 - DNA, 20 bp, Artificial sequence
  Synthetic oligonucleotide
gttgtgtgtcttcaccagct

SEQ ID NO: 62 - DNA, 20 bp, Artificial sequence
  Synthetic oligonucleotide
caggttgtgtgtcttcacca

SEQ ID NO: 63 - DNA, 20 bp, Artificial sequence
  Synthetic oligonucleotide
agcaggttgtgtgtcttcac

SEQ ID NO: 64 - DNA, 20 bp, Artificial sequence
  Synthetic oligonucleotide
gtcagcaggttgtgtgtctt

SEQ ID NO: 65 - DNA, 20 bp, Artificial sequence
  Synthetic oligonucleotide
tggtcagcaggttgtgtgtc

SEQ ID NO: 66 - DNA, 20 bp, Artificial sequence
  Synthetic oligonucleotide
tggtggtcagcaggttgtgt

SEQ ID NO: 67 - DNA, 20 bp, Artificial sequence
  Synthetic oligonucleotide
ctggtggtcagcaggttgtg

SEQ ID NO: 68 - DNA, 20 bp, Artificial sequence
  Synthetic oligonucleotide
cctggtggtcagcaggttgt

SEQ ID NO: 69 - DNA, 20 bp, Artificial sequence
  Synthetic oligonucleotide
gttcctggtggtcagcaggt

SEQ ID NO: 70 - DNA, 20 bp, Artificial sequence
  Synthetic oligonucleotide
agttcctggtggtcagcagg

SEQ ID NO: 71 - DNA, 20 bp, Artificial sequence
  Synthetic oligonucleotide
tagttcctggtggtcagcag

SEQ ID NO: 72 - DNA, 20 bp, Artificial sequence
  Synthetic oligonucleotide
atatagttcctggtggtcag

SEQ ID NO: 73 - DNA, 20 bp, Artificial sequence
  Synthetic oligonucleotide
agatatagttcctggtggtc

SEQ ID NO: 74 - DNA, 20 bp, Artificial sequence
  Synthetic oligonucleotide
caaagatatagttcctggtg

SEQ ID NO: 75 - DNA, 20 bp, Artificial sequence
  Synthetic oligonucleotide
ccaaagatatagttcctggt

SEQ ID NO: 76 - DNA, 20 bp, Artificial sequence
  Synthetic oligonucleotide
tccaaagatatagttcctgg

SEQ ID NO: 77 - DNA, 20 bp, Artificial sequence
  Synthetic oligonucleotide
gtatccaaagatatagttcc

SEQ ID NO: 78 - DNA, 20 bp, Artificial sequence
  Synthetic oligonucleotide
ggtatccaaagatatagttc

SEQ ID NO: 79 - DNA, 20 bp, Artificial sequence
  Synthetic oligonucleotide
tggtatccaaagatatagtt

SEQ ID NO: 80 - DNA, 20 bp, Artificial sequence
  Synthetic oligonucleotide
cagaaggcacccaggcccat

SEQ ID NO: 81 - DNA, 20 bp, Artificial sequence
  Synthetic oligonucleotide
tcttgccaggcatggagctc

SEQ ID NO: 82 - DNA, 20 bp, Artificial sequence
  Synthetic oligonucleotide
ttcttgccaggcatggagct

SEQ ID NO: 83 - DNA, 20 bp, Artificial sequence
  Synthetic oligonucleotide
ctggacccatcggccccagg

SEQ ID NO: 84 - DNA, 20 bp, Artificial sequence
  Synthetic oligonucleotide
tctggacccatcggccccag

SEQ ID NO: 85 - DNA, 20 bp, Artificial sequence
  Synthetic oligonucleotide
ttctggacccatcggcccca

SEQ ID NO: 86 - DNA, 20 bp, Artificial sequence
  Synthetic oligonucleotide
cttctggacccatcggcccc

SEQ ID NO: 87 - DNA, 20 bp, Artificial sequence
  Synthetic oligonucleotide
ttcttctggacccatcggcc

SEQ ID NO: 88 - DNA, 20 bp, Artificial sequence
  Synthetic oligonucleotide
cttcttctggacccatcggc

SEQ ID NO: 89 - DNA, 20 bp, Artificial sequence
  Synthetic oligonucleotide
acttcttctggacccatcgg

SEQ ID NO: 90 - DNA, 20 bp, Artificial sequence
  Synthetic oligonucleotide
aacttcttctggacccatcg

SEQ ID NO: 91 - DNA, 20 bp, Artificial sequence
  Synthetic oligonucleotide
gaacttcttctggacccatc

SEQ ID NO: 92 - DNA, 20 bp, Artificial sequence
  Synthetic oligonucleotide
ttctggaacttcttctggac

SEQ ID NO: 93 - DNA, 20 bp, Artificial sequence
  Synthetic oligonucleotide
ggcaccagcccccaggtgtc

SEQ ID NO: 94 - DNA, 20 bp, Artificial sequence
  Synthetic oligonucleotide
agtagggcaccagcccccag

SEQ ID NO: 95 - DNA, 20 bp, Artificial sequence
  Synthetic oligonucleotide
cttggagtagggcaccagcc

SEQ ID NO: 96 - DNA, 20 bp, Artificial sequence
  Synthetic oligonucleotide
cagggcctccatgtacatgg

SEQ ID NO: 97 - DNA, 20 bp, Artificial sequence
  Synthetic oligonucleotide
ttcaccagggcctccatgta

SEQ ID NO: 98 - DNA, 20 bp, Artificial sequence
  Synthetic oligonucleotide
agagcttcaccagggcctcc

SEQ ID NO: 99 - DNA, 20 bp, Artificial sequence
  Synthetic oligonucleotide
aacccacagacacccatgac

SEQ ID NO: 100 - DNA, 20 bp, Artificial sequence
  Synthetic oligonucleotide
taaataacccacagacaccc

SEQ ID NO: 101 - DNA, 20 bp, Artificial sequence
  Synthetic oligonucleotide
tcttttaaataacccacaga

SEQ ID NO: 102 - DNA, 20 bp, Artificial sequence
  Synthetic oligonucleotide
ggtgatgggcttggagtagg

SEQ ID NO: 103 - DNA, 20 bp, Artificial sequence
  Synthetic oligonucleotide
ccagggcctccatgtacatg

SEQ ID NO: 104 - DNA, 20 bp, Artificial sequence
  Synthetic oligonucleotide
ggaacttcttctggacccat

SEQ ID NO: 105 - DNA, 20 bp, Artificial sequence
  Synthetic oligonucleotide
tggaacttcttctggaccca

SEQ ID NO: 106 - DNA, 20 bp, Artificial sequence
  Synthetic oligonucleotide
ctggaacttcttctggaccc

SEQ ID NO: 107 - DNA, 20 bp, Artificial sequence
  Synthetic oligonucleotide
tctggaacttcttctggacc

SEQ ID NO: 108 - DNA, 20 bp, Artificial sequence
  Synthetic oligonucleotide
gggcaccagcccccaggtgt

SEQ ID NO: 109 - DNA, 20 bp, Artificial sequence
  Synthetic oligonucleotide
agggcaccagcccccaggtg

SEQ ID NO: 110 - DNA, 20 bp, Artificial sequence
  Synthetic oligonucleotide
tagggcaccagcccccaggt

SEQ ID NO: 111 - DNA, 20 bp, Artificial sequence
  Synthetic oligonucleotide
gtagggcaccagcccccagg

SEQ ID NO: 112 - DNA, 20 bp, Artificial sequence
  Synthetic oligonucleotide
gagtagggcaccagccccca

SEQ ID NO: 113 - DNA, 20 bp, Artificial sequence
  Synthetic oligonucleotide
ggagtagggcaccagccccc

SEQ ID NO: 114 - DNA, 20 bp, Artificial sequence
  Synthetic oligonucleotide
tggagtagggcaccagcccc

SEQ ID NO: 115 - DNA, 20 bp, Artificial sequence
  Synthetic oligonucleotide
ttggagtagggcaccagccc

SEQ ID NO: 116 - DNA, 20 bp, Artificial sequence
  Synthetic oligonucleotide
gcttggagtagggcaccagc

SEQ ID NO: 117 - DNA, 20 bp, Artificial sequence
  Synthetic oligonucleotide
ggcttggagtagggcaccag

SEQ ID NO: 118 - DNA, 20 bp, Artificial sequence
  Synthetic oligonucleotide
tggtgatgggcttggagtag

SEQ ID NO: 119 - DNA, 20 bp, Artificial sequence
  Synthetic oligonucleotide
gtggtgatgggcttggagta

SEQ ID NO: 120 - DNA, 20 bp, Artificial sequence
  Synthetic oligonucleotide
accagggcctccatgtacat

SEQ ID NO: 121 - DNA, 20 bp, Artificial sequence
  Synthetic oligonucleotide
caccagggcctccatgtaca

SEQ ID NO: 122 - DNA, 20 bp, Artificial sequence
  Synthetic oligonucleotide
tcaccagggcctccatgtac

SEQ ID NO: 123 - DNA, 20 bp, Artificial sequence
  Synthetic oligonucleotide
cttcaccagggcctccatgt

SEQ ID NO: 124 - DNA, 20 bp, Artificial sequence
  Synthetic oligonucleotide
gcttcaccagggcctccatg

SEQ ID NO: 125 - DNA, 20 bp, Artificial sequence
  Synthetic oligonucleotide
agcttcaccagggcctccat

SEQ ID NO: 126 - DNA, 20 bp, Artificial sequence
  Synthetic oligonucleotide
gagcttcaccagggcctcca

SEQ ID NO: 127 - DNA, 20 bp, Artificial sequence
  Synthetic oligonucleotide
aagagcttcaccagggcctc

SEQ ID NO: 128 - DNA, 20 bp, Artificial sequence
  Synthetic oligonucleotide
taacccacagacacccatga

SEQ ID NO: 129 - DNA, 20 bp, Artificial sequence
  Synthetic oligonucleotide
ataacccacagacacccatg

SEQ ID NO: 130 - DNA, 20 bp, Artificial sequence
  Synthetic oligonucleotide
aataacccacagacacccat

SEQ ID NO: 131 - DNA, 20 bp, Artificial sequence
  Synthetic oligonucleotide
aaataacccacagacaccca

SEQ ID NO: 132 - DNA, 20 bp, Artificial sequence
  Synthetic oligonucleotide
ttaaataacccacagacacc

SEQ ID NO: 133 - DNA, 20 bp, Artificial sequence
  Synthetic oligonucleotide
tttaaataacccacagacac

SEQ ID NO: 134 - DNA, 20 bp, Artificial sequence
  Synthetic oligonucleotide
ttttaaataacccacagaca

SEQ ID NO: 135 - DNA, 20 bp, Artificial sequence
  Synthetic oligonucleotide
cttttaaataacccacagac

SEQ ID NO: 136 - DNA, 20 bp, Artificial sequence
  Synthetic oligonucleotide
ttcttttaaataacccacag

SEQ ID NO: 137 - DNA, 20 bp, Artificial sequence
  Synthetic oligonucleotide
tttcttttaaataacccaca

SEQ ID NO: 138 - DNA, 20 bp, Artificial sequence
  Synthetic oligonucleotide
atttcttttaaataacccac

SEQ ID NO: 139 - DNA, 20 bp, Artificial sequence
  Synthetic oligonucleotide
aatttcttttaaataaccca

SEQ ID NO: 140 - DNA, 20 bp, Artificial sequence
  Synthetic oligonucleotide
taatttcttttaaataaccc

SEQ ID NO: 141 - DNA, 20 bp, Artificial sequence
  Synthetic oligonucleotide
ataatttcttttaaataacc

SEQ ID NO: 142 - DNA, 20 bp, Artificial sequence
  Synthetic oligonucleotide
tataatttcttttaaataac

SEQ ID NO: 143 - DNA, 20 bp, Artificial sequence
  Synthetic oligonucleotide
ttataatttcttttaaataa

SEQ ID NO: 144 - DNA, 20 bp, Artificial sequence
  Synthetic oligonucleotide
gcattgccactcccattctt

SEQ ID NO: 145 - DNA, 20 bp, Artificial sequence
  Synthetic oligonucleotide
aggaccccggagtaggcggc

SEQ ID NO: 146 - DNA, 20 bp, Artificial sequence
  Synthetic oligonucleotide
gacctattgagccaggtgac

SEQ ID NO: 147 - DNA, 20 bp, Artificial sequence
  Synthetic oligonucleotide
gtagctgcttttccaccttg

SEQ ID NO: 148 - DNA, 20 bp, Artificial sequence
  Synthetic oligonucleotide
gtgcagaatatgtacatgag

SEQ ID NO: 149 - DNA, 20 bp, Artificial sequence
  Synthetic oligonucleotide
tgcagaaggcacccaggccc

SEQ ID NO: 150 - DNA, 20 bp, Artificial sequence
  Synthetic oligonucleotide
agctcagagactcagccgca

SEQ ID NO: 151 - DNA, 20 bp, Artificial sequence
  Synthetic oligonucleotide
tggtcttgtgcttgtcgaag

SEQ ID NO: 152 - DNA, 20 bp, Artificial sequence
  Synthetic oligonucleotide
agctgcttttccaccttgga

SEQ ID NO: 153 - DNA, 20 bp, Artificial sequence
  Synthetic oligonucleotide
tggagctcagagactcagcc

SEQ ID NO: 154 - DNA, 20 bp, Artificial sequence
  Synthetic oligonucleotide
gctgcatccatgtcatcagc

SEQ ID NO: 155 - DNA, 20 bp, Artificial sequence
  Synthetic oligonucleotide
aggaaggacaggacccactg

SEQ ID NO: 156 - DNA, 20 bp, Artificial sequence
  Synthetic oligonucleotide
atgagggtcttcatggctga

SEQ ID NO: 157 - DNA, 20 bp, Artificial sequence
  Synthetic oligonucleotide
gagtaggcggctatgagggt

SEQ ID NO: 158 - DNA, 20 bp, Artificial sequence
  Synthetic oligonucleotide
ccggagtaggcggctatgag

SEQ ID NO: 159 - DNA, 20 bp, Artificial sequence
  Synthetic oligonucleotide
accccggagtaggcggctat

SEQ ID NO: 160 - DNA, 20 bp, Artificial sequence
  Synthetic oligonucleotide
ggtcagcctcggcctgacgc

SEQ ID NO: 161 - DNA, 20 bp, Artificial sequence
  Synthetic oligonucleotide
tccggtcagcctcggcctga

SEQ ID NO: 162 - DNA, 20 bp, Artificial sequence
  Synthetic oligonucleotide
ggctccggtcagcctcggcc

SEQ ID NO: 163 - DNA, 20 bp, Artificial sequence
  Synthetic oligonucleotide
caggtcctccgtgagagcgc

SEQ ID NO: 164 - DNA, 20 bp, Artificial sequence
  Synthetic oligonucleotide
cgacagcgcaggtcctccgt

SEQ ID NO: 165 - DNA, 20 bp, Artificial sequence
  Synthetic oligonucleotide
cccctcgcgcgacagcgcag

SEQ ID NO: 166 - DNA, 20 bp, Artificial sequence
  Synthetic oligonucleotide
tcccagacccctcgcgcgac

SEQ ID NO: 167 - DNA, 20 bp, Artificial sequence
  Synthetic oligonucleotide
cccatctcccagacccctcg

SEQ ID NO: 168 - DNA, 20 bp, Artificial sequence
  Synthetic oligonucleotide
cagtgccccatctcccagac

SEQ ID NO: 169 - DNA, 20 bp, Artificial sequence
  Synthetic oligonucleotide
atccagtgccccatctccca

SEQ ID NO: 170 - DNA, 20 bp, Artificial sequence
  Synthetic oligonucleotide
tgctggatccagtgccccat

SEQ ID NO: 171 - DNA, 20 bp, Artificial sequence
  Synthetic oligonucleotide
ggatgctggatccagtgccc

SEQ ID NO: 172 - DNA, 20 bp, Artificial sequence
  Synthetic oligonucleotide
agaggatgctggatccagtg

SEQ ID NO: 173 - DNA, 20 bp, Artificial sequence
  Synthetic oligonucleotide
cggagaggatgctggatcca

SEQ ID NO: 174 - DNA, 20 bp, Artificial sequence
  Synthetic oligonucleotide
gtcctggagggcggagagga

SEQ ID NO: 175 - DNA, 20 bp, Artificial sequence
  Synthetic oligonucleotide
gagaagaggtcctggagggc

SEQ ID NO: 176 - DNA, 20 bp, Artificial sequence
  Synthetic oligonucleotide
cctgtagctgcttttccacc

SEQ ID NO: 177 - DNA, 20 bp, Artificial sequence
  Synthetic oligonucleotide
tgacctgtagctgcttttcc

SEQ ID NO: 178 - DNA, 20 bp, Artificial sequence
  Synthetic oligonucleotide
gagatgacctgtagctgctt

SEQ ID NO: 179 - DNA, 20 bp, Artificial sequence
  Synthetic oligonucleotide
actgagatgacctgtagctg

SEQ ID NO: 180 - DNA, 20 bp, Artificial sequence
  Synthetic oligonucleotide
agcactgagatgacctgtag

SEQ ID NO: 181 - DNA, 20 bp, Artificial sequence
  Synthetic oligonucleotide
cactggagcactgagatgac

SEQ ID NO: 182 - DNA, 20 bp, Artificial sequence
  Synthetic oligonucleotide
aggacccactggagcactga

SEQ ID NO: 183 - DNA, 20 bp, Artificial sequence
  Synthetic oligonucleotide
gacaggacccactggagcac

SEQ ID NO: 184 - DNA, 20 bp, Artificial sequence
  Synthetic oligonucleotide
actcccagtacaaggaagga

SEQ ID NO: 185 - DNA, 20 bp, Artificial sequence
  Synthetic oligonucleotide
gccactcccagtacaaggaa

SEQ ID NO: 186 - DNA, 20 bp, Artificial sequence
  Synthetic oligonucleotide
caggccactcccagtacaag

SEQ ID NO: 187 - DNA, 20 bp, Artificial sequence
  Synthetic oligonucleotide
ctgcaggccactcccagtac

SEQ ID NO: 188 - DNA, 20 bp, Artificial sequence
  Synthetic oligonucleotide
gcactgcaggccactcccag

SEQ ID NO: 189 - DNA, 20 bp, Artificial sequence
  Synthetic oligonucleotide
gatggcactgcaggccactc

SEQ ID NO: 190 - DNA, 20 bp, Artificial sequence
  Synthetic oligonucleotide
agcacagcgatgagccagca

SEQ ID NO: 191 - DNA, 20 bp, Artificial sequence
  Synthetic oligonucleotide
cagccaagtgaagtagagca

SEQ ID NO: 192 - DNA, 20 bp, Artificial sequence
  Synthetic oligonucleotide
caccagccaagtgaagtaga

SEQ ID NO: 193 - DNA, 20 bp, Artificial sequence
  Synthetic oligonucleotide
aaacaccagccaagtgaagt

SEQ ID NO: 194 - DNA, 20 bp, Artificial sequence
  Synthetic oligonucleotide
gtcaaacaccagccaagtga

SEQ ID NO: 195 - DNA, 20 bp, Artificial sequence
  Synthetic oligonucleotide
gttccagtcaaacaccagcc

SEQ ID NO: 196 - DNA, 20 bp, Artificial sequence
  Synthetic oligonucleotide
tgtgttccagtcaaacacca

SEQ ID NO: 197 - DNA, 20 bp, Artificial sequence
  Synthetic oligonucleotide
gggtgtgttccagtcaaaca

SEQ ID NO: 198 - DNA, 20 bp, Artificial sequence
  Synthetic oligonucleotide
cttgggtgtgttccagtcaa

SEQ ID NO: 199 - DNA, 20 bp, Artificial sequence
  Synthetic oligonucleotide
ctgtgacctcctgccacctt

SEQ ID NO: 200 - DNA, 20 bp, Artificial sequence
  Synthetic oligonucleotide
ccactgtgacctcctgccac

SEQ ID NO: 201 - DNA, 20 bp, Artificial sequence
  Synthetic oligonucleotide
gacccactgtgacctcctgc

SEQ ID NO: 202 - DNA, 20 bp, Artificial sequence
  Synthetic oligonucleotide
ttcggacccactgtgacctc

SEQ ID NO: 203 - DNA, 20 bp, Artificial sequence
  Synthetic oligonucleotide
cagtttcggacccactgtga

SEQ ID NO: 204 - DNA, 20 bp, Artificial sequence
  Synthetic oligonucleotide
gcccagtttcggacccactg

SEQ ID NO: 205 - DNA, 20 bp, Artificial sequence
  Synthetic oligonucleotide
acagcccagtttcggaccca

SEQ ID NO: 206 - DNA, 20 bp, Artificial sequence
  Synthetic oligonucleotide
cacacagcccagtttcggac

SEQ ID NO: 207 - DNA, 20 bp, Artificial sequence
  Synthetic oligonucleotide
gcgccacacagcccagtttc

SEQ ID NO: 208 - DNA, 20 bp, Artificial sequence
  Synthetic oligonucleotide
agtagtctcgaaagtagcgc

SEQ ID NO: 209 - DNA, 20 bp, Artificial sequence
  Synthetic oligonucleotide
gaaagtagtctcgaaagtag

SEQ ID NO: 210 - DNA, 20 bp, Artificial sequence
  Synthetic oligonucleotide
atgggaaagtagtctcgaaa

SEQ ID NO: 211 - DNA, 20 bp, Artificial sequence
  Synthetic oligonucleotide
ttctgtggcctctgtgctga

SEQ ID NO: 212 - DNA, 20 bp, Artificial sequence
  Synthetic oligonucleotide
cacttctgtggcctctgtgc

SEQ ID NO: 213 - DNA, 20 bp, Artificial sequence
  Synthetic oligonucleotide
gctcacttctgtggcctctg

SEQ ID NO: 214 - DNA, 20 bp, Artificial sequence
  Synthetic oligonucleotide
cttgctcacttctgtggcct

SEQ ID NO: 215 - DNA, 20 bp, Artificial sequence
  Synthetic oligonucleotide
cttcttgctcacttctgtgg

SEQ ID NO: 216 - DNA, 20 bp, Artificial sequence
  Synthetic oligonucleotide
tgggaacttcttgctcactt

SEQ ID NO: 217 - DNA, 20 bp, Artificial sequence
  Synthetic oligonucleotide
gcctgggaacttcttgctca

SEQ ID NO: 218 - DNA, 20 bp, Artificial sequence
  Synthetic oligonucleotide
tatgcctgggaacttcttgc

SEQ ID NO: 219 - DNA, 20 bp, Artificial sequence
  Synthetic oligonucleotide
gccgtatgcctgggaacttc

SEQ ID NO: 220 - DNA, 20 bp, Artificial sequence
  Synthetic oligonucleotide
aaggccgtatgcctgggaac

SEQ ID NO: 221 - DNA, 20 bp, Artificial sequence
  Synthetic oligonucleotide
ggtaaggccgtatgcctggg

SEQ ID NO: 222 - DNA, 20 bp, Artificial sequence
  Synthetic oligonucleotide
ttgcggttccgcagggtgac

SEQ ID NO: 223 - DNA, 20 bp, Artificial sequence
  Synthetic oligonucleotide
acccatcggccccaggagcc

SEQ ID NO: 224 - DNA, 20 bp, Artificial sequence
  Synthetic oligonucleotide
ccatgtacatggtgtggtac

SEQ ID NO: 225 - DNA, 20 bp, Artificial sequence
  Synthetic oligonucleotide
ccaggtaaggccgtatgcct

SEQ ID NO: 226 - DNA, 20 bp, Artificial sequence
  Synthetic oligonucleotide
tagccaggtaaggccgtatg

SEQ ID NO: 227 - DNA, 20 bp, Artificial sequence
  Synthetic oligonucleotide
gtgtagccaggtaaggccgt

SEQ ID NO: 228 - DNA, 20 bp, Artificial sequence
  Synthetic oligonucleotide
gccagtgtagccaggtaagg

SEQ ID NO: 229 - DNA, 20 bp, Artificial sequence
  Synthetic oligonucleotide
gtactccctcaacacaggca

SEQ ID NO: 230 - DNA, 20 bp, Artificial sequence
  Synthetic oligonucleotide
caggtactccctcaacacag

SEQ ID NO: 231 - DNA, 20 bp, Artificial sequence
  Synthetic oligonucleotide
catcaggtactccctcaaca

SEQ ID NO: 232 - DNA, 20 bp, Artificial sequence
  Synthetic oligonucleotide
agacatcaggtactccctca

SEQ ID NO: 233 - DNA, 20 bp, Artificial sequence
  Synthetic oligonucleotide
atacctccagacatcaggta

SEQ ID NO: 234 - DNA, 20 bp, Artificial sequence
  Synthetic oligonucleotide
cagatacctccagacatcag

SEQ ID NO: 235 - DNA, 20 bp, Artificial sequence
  Synthetic oligonucleotide
acagggcagatacctccaga

SEQ ID NO: 236 - DNA, 20 bp, Artificial sequence
  Synthetic oligonucleotide
aatagtctatggtgtcccgg

SEQ ID NO: 237 - DNA, 20 bp, Artificial sequence
  Synthetic oligonucleotide
gcaaatagtctatggtgtcc

SEQ ID NO: 238 - DNA, 20 bp, Artificial sequence
  Synthetic oligonucleotide
aaagcaaatagtctatggtg

SEQ ID NO: 239 - DNA, 20 bp, Artificial sequence
  Synthetic oligonucleotide
ttgaaagcaaatagtctatg

SEQ ID NO: 240 - DNA, 20 bp, Artificial sequence
  Synthetic oligonucleotide
tctttgaaagcaaatagtct

SEQ ID NO: 241 - DNA, 20 bp, Artificial sequence
  Synthetic oligonucleotide
cattctttgaaagcaaatag

SEQ ID NO: 242 - DNA, 20 bp, Artificial sequence
  Synthetic oligonucleotide
tcccattctttgaaagcaaa

SEQ ID NO: 243 - DNA, 20 bp, Artificial sequence
  Synthetic oligonucleotide
ccactcccattctttgaaag

SEQ ID NO: 244 - DNA, 20 bp, Artificial sequence
  Synthetic oligonucleotide
ttgccactcccattctttga

SEQ ID NO: 245 - DNA, 20 bp, Artificial sequence
  Synthetic oligonucleotide
tcagagactcagccgcaccc

SEQ ID NO: 246 - DNA, 20 bp, Artificial sequence
  Synthetic oligonucleotide
aggcatggagctcagagact

SEQ ID NO: 247 - DNA, 20 bp, Artificial sequence
  Synthetic oligonucleotide
gactgcattcttgccaggca

SEQ ID NO: 248 - DNA, 20 bp, Artificial sequence
  Synthetic oligonucleotide
ggtgactgcattcttgccag

SEQ ID NO: 249 - DNA, 20 bp, Artificial sequence
  Synthetic oligonucleotide
tccgcagggtgactgcattc

SEQ ID NO: 250 - DNA, 20 bp, Artificial sequence
  Synthetic oligonucleotide
cccttgcggttccgcagggt

SEQ ID NO: 251 - DNA, 20 bp, Artificial sequence
  Synthetic oligonucleotide
aagcccttgcggttccgcag

SEQ ID NO: 252 - DNA, 20 bp, Artificial sequence
  Synthetic oligonucleotide
acaaagcccttgcggttccg

SEQ ID NO: 253 - DNA, 20 bp, Artificial sequence
  Synthetic oligonucleotide
agtttcacaaagcccttgcg

SEQ ID NO: 254 - DNA, 20 bp, Artificial sequence
  Synthetic oligonucleotide
gccagtttcacaaagccctt

SEQ ID NO: 255 - DNA, 20 bp, Artificial sequence
  Synthetic oligonucleotide
agggccagtttcacaaagcc

SEQ ID NO: 256 - DNA, 20 bp, Artificial sequence
  Synthetic oligonucleotide
cgcagggccagtttcacaaa

SEQ ID NO: 257 - DNA, 20 bp, Artificial sequence
  Synthetic oligonucleotide
tcattctctccaaaggagta

SEQ ID NO: 258 - DNA, 20 bp, Artificial sequence
  Synthetic oligonucleotide
acttcattctctccaaagga

SEQ ID NO: 259 - DNA, 20 bp, Artificial sequence
  Synthetic oligonucleotide
gtacacttcattctctccaa

SEQ ID NO: 260 - DNA, 20 bp, Artificial sequence
  Synthetic oligonucleotide
ctgcttgtacacttcattct

SEQ ID NO: 261 - DNA, 20 bp, Artificial sequence
  Synthetic oligonucleotide
tcacctgcttgtacacttca

SEQ ID NO: 262 - DNA, 20 bp, Artificial sequence
  Synthetic oligonucleotide
cgaagatcacctgcttgtac

SEQ ID NO: 263 - DNA, 20 bp, Artificial sequence
  Synthetic oligonucleotide
cctcgaagatcacctgcttg

SEQ ID NO: 264 - DNA, 20 bp, Artificial sequence
  Synthetic oligonucleotide
cctcctcgaagatcacctgc

SEQ ID NO: 265 - DNA, 20 bp, Artificial sequence
  Synthetic oligonucleotide
agccctcctcgaagatcacc

SEQ ID NO: 266 - DNA, 20 bp, Artificial sequence
  Synthetic oligonucleotide
aggagccctcctcgaagatc

SEQ ID NO: 267 - DNA, 20 bp, Artificial sequence
  Synthetic oligonucleotide
cccaggagccctcctcgaag

SEQ ID NO: 268 - DNA, 20 bp, Artificial sequence
  Synthetic oligonucleotide
ggccccaggagccctcctcg

SEQ ID NO: 269 - DNA, 20 bp, Artificial sequence
  Synthetic oligonucleotide
tatttctggaacttcttctg

SEQ ID NO: 270 - DNA, 20 bp, Artificial sequence
  Synthetic oligonucleotide
atgtatttctggaacttctt

SEQ ID NO: 271 - DNA, 20 bp, Artificial sequence
  Synthetic oligonucleotide
gggcgaaaccaatgtatttc

SEQ ID NO: 272 - DNA, 20 bp, Artificial sequence
  Synthetic oligonucleotide
tcggaggagaagaggcctcg

SEQ ID NO: 273 - DNA, 20 bp, Artificial sequence
  Synthetic oligonucleotide
gtgtcggaggagaagaggcc

SEQ ID NO: 274 - DNA, 20 bp, Artificial sequence
  Synthetic oligonucleotide
ccaggtgtcggaggagaaga

SEQ ID NO: 275 - DNA, 20 bp, Artificial sequence
  Synthetic oligonucleotide
ccagcccccaggtgtcggag

SEQ ID NO: 276 - DNA, 20 bp, Artificial sequence
  Synthetic oligonucleotide
acagtggtgatgggcttgga

SEQ ID NO: 277 - DNA, 20 bp, Artificial sequence
  Synthetic oligonucleotide
ggatggtgatgggctctccc

SEQ ID NO: 278 - DNA, 20 bp, Artificial sequence
  Synthetic oligonucleotide
gcctccatgtacatggtgtg

SEQ ID NO: 279 - DNA, 20 bp, Artificial sequence
  Synthetic oligonucleotide
tcttgtgcttgtcgaagagc

SEQ ID NO: 280 - DNA, 20 bp, Artificial sequence
  Synthetic oligonucleotide
cctccaggacctcagtctcc

SEQ ID NO: 281 - DNA, 20 bp, Artificial sequence
  Synthetic oligonucleotide
ttcacctccaggacctcagt

SEQ ID NO: 282 - DNA, 20 bp, Artificial sequence
  Synthetic oligonucleotide
tcagttcacctccaggacct

SEQ ID NO: 283 - DNA, 20 bp, Artificial sequence
  Synthetic oligonucleotide
ctggctcagttcacctccag

SEQ ID NO: 284 - DNA, 20 bp, Artificial sequence
  Synthetic oligonucleotide
tgtaatggtttagcaaaatt

SEQ ID NO: 285 - DNA, 20 bp, Artificial sequence
  Synthetic oligonucleotide
ttaaaaaagacctaacattg

SEQ ID NO: 286 - DNA, 20 bp, Artificial sequence
  Synthetic oligonucleotide
cttcttaaaaaagacctaac

SEQ ID NO: 287 - DNA, 20 bp, Artificial sequence
  Synthetic oligonucleotide
tttccttcttaaaaaagacc

SEQ ID NO: 288 - DNA, 20 bp, Artificial sequence
  Synthetic oligonucleotide
actttttccttcttaaaaaa

SEQ ID NO: 289 - DNA, 20 bp, Artificial sequence
  Synthetic oligonucleotide
tactgactttttccttctta

SEQ ID NO: 290 - DNA, 20 bp, Artificial sequence
  Synthetic oligonucleotide
ccaccacctagaacagggca

SEQ ID NO: 291 - DNA, 20 bp, Artificial sequence
  Synthetic oligonucleotide
aggttagctgagccacccag

SEQ ID NO: 292 - DNA, 20 bp, Artificial sequence
  Synthetic oligonucleotide
gtcctgcagtttcaggacta

SEQ ID NO: 293 - DNA, 20 bp, Artificial sequence
  Synthetic oligonucleotide
actggtcctgcagtttcagg

SEQ ID NO: 294 - DNA, 20 bp, Artificial sequence
  Synthetic oligonucleotide
tccccttggcagagaaactg

SEQ ID NO: 295 - DNA, 20 bp, Artificial sequence
  Synthetic oligonucleotide
ctcctccccttggcagagaa

SEQ ID NO: 296 - DNA, 20 bp, Artificial sequence
  Synthetic oligonucleotide
ccaactcctccccttggcag

SEQ ID NO: 297 - DNA, 20 bp, Artificial sequence
  Synthetic oligonucleotide
ctctccaactcctccccttg

SEQ ID NO: 298 - DNA, 20 bp, Artificial sequence
  Synthetic oligonucleotide
gtgctctccaactcctcccc

SEQ ID NO: 299 - DNA, 20 bp, Artificial sequence
  Synthetic oligonucleotide
ctggaggccagtccaggctc

SEQ ID NO: 300 - DNA, 20 bp, Artificial sequence
  Synthetic oligonucleotide
atcctggaggccagtccagg

SEQ ID NO: 301 - DNA, 20 bp, Artificial sequence
  Synthetic oligonucleotide
cccccatcctcatcctggag

SEQ ID NO: 302 - DNA, 20 bp, Artificial sequence
  Synthetic oligonucleotide
gccacccccatcctcatcct

SEQ ID NO: 303 - DNA, 20 bp, Artificial sequence
  Synthetic oligonucleotide
cattgccacccccatcctca

SEQ ID NO: 304 - DNA, 20 bp, Artificial sequence
  Synthetic oligonucleotide
gggcagtcctttcccctgca

SEQ ID NO: 305 - DNA, 20 bp, Artificial sequence
  Synthetic oligonucleotide
tagctcatggtggcggcatc

SEQ ID NO: 306 - DNA, 20 bp, Artificial sequence
  Synthetic oligonucleotide
tccacctagctcatggtggc

SEQ ID NO: 307 - DNA, 20 bp, Artificial sequence
  Synthetic oligonucleotide
ttactccacctagctcatgg

SEQ ID NO: 308 - DNA, 20 bp, Artificial sequence
  Synthetic oligonucleotide
aaaaccagttactccaccta

SEQ ID NO: 309 - DNA, 20 bp, Artificial sequence
  Synthetic oligonucleotide
agaaaaaccagttactccac

SEQ ID NO: 310 - DNA, 20 bp, Artificial sequence
  Synthetic oligonucleotide
tcagccacccaagaaaaacc

SEQ ID NO: 311 - DNA, 20 bp, Artificial sequence
  Synthetic oligonucleotide
catgtcatcagccacccaag

SEQ ID NO: 312 - DNA, 20 bp, Artificial sequence
  Synthetic oligonucleotide
tgtgctgcatccatgtcatc

SEQ ID NO: 313 - DNA, 20 bp, Artificial sequence
  Synthetic oligonucleotide
gagtctgtgctgcatccatg

SEQ ID NO: 314 - DNA, 20 bp, Artificial sequence
  Synthetic oligonucleotide
caaggctgagtctgtgctgc

SEQ ID NO: 315 - DNA, 20 bp, Artificial sequence
  Synthetic oligonucleotide
ggccaaggctgagtctgtgc

SEQ ID NO: 316 - DNA, 20 bp, Artificial sequence
  Synthetic oligonucleotide
ccaggccaaggctgagtctg

SEQ ID NO: 317 - DNA, 20 bp, Artificial sequence
  Synthetic oligonucleotide
aaggtaaactgaggccacca

SEQ ID NO: 318 - DNA, 20 bp, Artificial sequence
  Synthetic oligonucleotide
gggaaggtaaactgaggcca

SEQ ID NO: 319 - DNA, 20 bp, Artificial sequence
  Synthetic oligonucleotide
aggccccttctgaagaggga

SEQ ID NO: 320 - DNA, 20 bp, Artificial sequence
  Synthetic oligonucleotide
gccaggccccttctgaagag

SEQ ID NO: 321 - DNA, 20 bp, Artificial sequence
  Synthetic oligonucleotide
aaggccaggccccttctgaa

SEQ ID NO: 322 - DNA, 20 bp, Artificial sequence
  Synthetic oligonucleotide
tcagaaggccaggccccttc

SEQ ID NO: 323 - DNA, 20 bp, Artificial sequence
  Synthetic oligonucleotide
tgctgctcagaaggccaggc

SEQ ID NO: 324 - DNA, 20 bp, Artificial sequence
  Synthetic oligonucleotide
taatctgctgctcagaaggc

SEQ ID NO: 325 - DNA, 20 bp, Artificial sequence
  Synthetic oligonucleotide
tttggaactaatctgctgct

SEQ ID NO: 326 - DNA, 20 bp, Artificial sequence
  Synthetic oligonucleotide
gccacctgctttggaactaa

SEQ ID NO: 327 - DNA, 20 bp, Artificial sequence
  Synthetic oligonucleotide
acagaaaagtgaggcttggg

SEQ ID NO: 328 - DNA, 20 bp, Artificial sequence
  Synthetic oligonucleotide
ggcacagaaaagtgaggctt

SEQ ID NO: 329 - DNA, 20 bp, Artificial sequence
  Synthetic oligonucleotide
gaaggcacagaaaagtgagg

SEQ ID NO: 330 - DNA, 20 bp, Artificial sequence
  Synthetic oligonucleotide
caggaaggcacagaaaagtg

SEQ ID NO: 331 - DNA, 20 bp, Artificial sequence
  Synthetic oligonucleotide
cctcaggaaggcacagaaaa

SEQ ID NO: 332 - DNA, 20 bp, Artificial sequence
  Synthetic oligonucleotide
accccctcaggaaggcacag

SEQ ID NO: 333 - DNA, 20 bp, Artificial sequence
  Synthetic oligonucleotide
ggcccaaccccctcaggaag

SEQ ID NO: 334 - DNA, 20 bp, Artificial sequence
  Synthetic oligonucleotide
tctcatcaagagataacaga

SEQ ID NO: 335 - DNA, 20 bp, Artificial sequence
  Synthetic oligonucleotide
tgatctcatcaagagataac

SEQ ID NO: 336 - DNA, 20 bp, Artificial sequence
  Synthetic oligonucleotide
tacaaaagtctgacatggtg

SEQ ID NO: 337 - DNA, 20 bp, Artificial sequence
  Synthetic oligonucleotide
atatacaaaagtctgacatg

SEQ ID NO: 338 - DNA, 20 bp, Artificial sequence
  Synthetic oligonucleotide
aggcatatacaaaagtctga

SEQ ID NO: 339 - DNA, 20 bp, Artificial sequence
  Synthetic oligonucleotide
agcctgccacagggcccttt

SEQ ID NO: 340 - DNA, 20 bp, Artificial sequence
  Synthetic oligonucleotide
aggacagggcagacacacct

SEQ ID NO: 341 - DNA, 20 bp, Artificial sequence
  Synthetic oligonucleotide
gatttgtacttgaatccagg

SEQ ID NO: 342 - DNA, 20 bp, Artificial sequence
  Synthetic oligonucleotide
acacgcagaccaggacagct

SEQ ID NO: 343 - DNA, 20 bp, Artificial sequence
  Synthetic oligonucleotide
tttggatagtcgatttacca

SEQ ID NO: 344 - DNA, 20 bp, Artificial sequence
  Synthetic oligonucleotide
aagattcataactatatcta

SEQ ID NO: 345 - DNA, 20 bp, Artificial sequence
  Synthetic oligonucleotide
aaaaacatgacagccagggt

SEQ ID NO: 346 - DNA, 20 bp, Artificial sequence
  Synthetic oligonucleotide
gacttcccttcacagaatcc

SEQ ID NO: 347 - DNA, 20 bp, Artificial sequence
  Synthetic oligonucleotide
caggcaggtgtcagagggct

SEQ ID NO: 348 - DNA, 20 bp, Artificial sequence
  Synthetic oligonucleotide
tagcctggctttgataaccc

SEQ ID NO: 349 - DNA, 20 bp, Artificial sequence
  Synthetic oligonucleotide
cataggccaggaggaagagt

SEQ ID NO: 350 - DNA, 20 bp, Artificial sequence
  Synthetic oligonucleotide
ttgcttaaacagataagcac

SEQ ID NO: 351 - DNA, 20 bp, Artificial sequence
  Synthetic oligonucleotide
aatgtcacaagttcacaaac

SEQ ID NO: 352 - DNA, 20 bp, Artificial sequence
  Synthetic oligonucleotide
ctgacctcagggtgatcaag

SEQ ID NO: 353 - DNA, 20 bp, Artificial sequence
  Synthetic oligonucleotide
ccaagcaggagctggacaga

SEQ ID NO: 354 - DNA, 20 bp, Artificial sequence
  Synthetic oligonucleotide
tcatttcatagatgaggaga

SEQ ID NO: 355 - DNA, 20 bp, Artificial sequence
  Synthetic oligonucleotide
aggagtttgtgtttcccatt

SEQ ID NO: 356 - DNA, 20 bp, Artificial sequence
  Synthetic oligonucleotide
ggcagggcttagaatggcta

SEQ ID NO: 357 - DNA, 20 bp, Artificial sequence
  Synthetic oligonucleotide
accattttcacaaggagaag

SEQ ID NO: 358 - DNA, 20 bp, Artificial sequence
  Synthetic oligonucleotide
ttcaaaaagtagctactgca

SEQ ID NO: 359 - DNA, 20 bp, Artificial sequence
  Synthetic oligonucleotide
tccaggaccctggacatgat

SEQ ID NO: 360 - DNA, 20 bp, Artificial sequence
  Synthetic oligonucleotide
agagccagcacacagctatg

SEQ ID NO: 361 - DNA, 20 bp, Artificial sequence
  Synthetic oligonucleotide
agtctagttggaaaagtaga

SEQ ID NO: 362 - DNA, 20 bp, Artificial sequence
  Synthetic oligonucleotide
agatgccacttcatcaaggc

SEQ ID NO: 363 - DNA, 20 bp, Artificial sequence
  Synthetic oligonucleotide
gaagtcaggccaagtgccaa

SEQ ID NO: 364 - DNA, 20 bp, Artificial sequence
  Synthetic oligonucleotide
tgattcttacctgcaatgag

SEQ ID NO: 365 - DNA, 20 bp, Artificial sequence
  Synthetic oligonucleotide
ccaagtaagcctcggtgtcc

SEQ ID NO: 366 - DNA, 20 bp, Artificial sequence
  Synthetic oligonucleotide
tgagtagtcaaaggtggctt

SEQ ID NO: 367 - DNA, 20 bp, Artificial sequence
  Synthetic oligonucleotide
atgcctgagggcagcagtgt

SEQ ID NO: 368 - DNA, 20 bp, Artificial sequence
  Synthetic oligonucleotide
tgaccaggaaggccacacct

SEQ ID NO: 369 - DNA, 20 bp, Artificial sequence
  Synthetic oligonucleotide
ggcttcaccgtcccacagca

SEQ ID NO: 370 - DNA, 20 bp, Artificial sequence
  Synthetic oligonucleotide
caggacttggtacctgattc

SEQ ID NO: 371 - DNA, 20 bp, Artificial sequence
  Synthetic oligonucleotide
tggctgggaggagtccagca

SEQ ID NO: 372 - DNA, 20 bp, Artificial sequence
  Synthetic oligonucleotide
gggtcaaggtcactcagcca

SEQ ID NO: 373 - DNA, 20 bp, Artificial sequence
  Synthetic oligonucleotide
tatttgaagataaagtcaga

SEQ ID NO: 374 - DNA, 20 bp, Artificial sequence
  Synthetic oligonucleotide
gggatgataaacactaaggt

SEQ ID NO: 375 - DNA, 20 bp, Artificial sequence
  Synthetic oligonucleotide
acccagagatggtgataagg

SEQ ID NO: 376 - DNA, 20 bp, Artificial sequence
  Synthetic oligonucleotide
aagtgaaccctcacttccca

SEQ ID NO: 377 - DNA, 20 bp, Artificial sequence
  Synthetic oligonucleotide
acatatccccaactgaaaca

SEQ ID NO: 378 - DNA, 20 bp, Artificial sequence
  Synthetic oligonucleotide
tcactgatgacatatcccca

SEQ ID NO: 379 - DNA, 20 bp, Artificial sequence
  Synthetic oligonucleotide
gagtatagaaatttcactga

SEQ ID NO: 380 - DNA, 20 bp, Artificial sequence
  Synthetic oligonucleotide
tgcagcttggaggaggagta

SEQ ID NO: 381 - DNA, 20 bp, Artificial sequence
  Synthetic oligonucleotide
gcattttaacaagatcccca

SEQ ID NO: 382 - DNA, 20 bp, Artificial sequence
  Synthetic oligonucleotide
ctgaatcaaaatctgcattt

SEQ ID NO: 383 - DNA, 20 bp, Artificial sequence
  Synthetic oligonucleotide
tccagactggatttactgaa

SEQ ID NO: 384 - DNA, 20 bp, Artificial sequence
  Synthetic oligonucleotide
ttatccttgagggtctcata

SEQ ID NO: 385 - DNA, 20 bp, Artificial sequence
  Synthetic oligonucleotide
catcacatgcttatccttga

SEQ ID NO: 386 - DNA, 20 bp, Artificial sequence
  Synthetic oligonucleotide
ttccccagagcagctctgag

SEQ ID NO: 387 - DNA, 20 bp, Artificial sequence
  Synthetic oligonucleotide
gcggcagagccaggactgaa

SEQ ID NO: 388 - DNA, 20 bp, Artificial sequence
  Synthetic oligonucleotide
gtcatccagtatagcctaat

SEQ ID NO: 389 - DNA, 20 bp, Artificial sequence
  Synthetic oligonucleotide
taaagaggctgggccataga

SEQ ID NO: 390 - DNA, 20 bp, Artificial sequence
  Synthetic oligonucleotide
tcaaacctaggttcagactt

SEQ ID NO: 391 - DNA, 20 bp, Artificial sequence
  Synthetic oligonucleotide
aggaaggaaatgctaggcct

SEQ ID NO: 392 - DNA, 20 bp, Artificial sequence
  Synthetic oligonucleotide
acaggaagcctggtgactgc

SEQ ID NO: 393 - DNA, 20 bp, Artificial sequence
  Synthetic oligonucleotide
caggcagcctgaaggacact

SEQ ID NO: 394 - DNA, 20 bp, Artificial sequence
  Synthetic oligonucleotide
aggacagaggttcaacatcc

SEQ ID NO: 395 - DNA, 20 bp, Artificial sequence
  Synthetic oligonucleotide
agaccacatgaagtatctaa

SEQ ID NO: 396 - DNA, 20 bp, Artificial sequence
  Synthetic oligonucleotide
gctatagaatcagacagacc

SEQ ID NO: 397 - DNA, 20 bp, Artificial sequence
  Synthetic oligonucleotide
cctacagcagagggaagatg

SEQ ID NO: 398 - DNA, 20 bp, Artificial sequence
  Synthetic oligonucleotide
cagtgcctacagcagaggga

SEQ ID NO: 399 - DNA, 20 bp, Artificial sequence
  Synthetic oligonucleotide
gatgctggatccagtgccta

SEQ ID NO: 400 - DNA, 20 bp, Artificial sequence
  Synthetic oligonucleotide
gtgggaaaggcacaggcttt

SEQ ID NO: 401 - DNA, 20 bp, Artificial sequence
  Synthetic oligonucleotide
gatggcaacctaaggagtga

SEQ ID NO: 402 - DNA, 20 bp, Artificial sequence
  Synthetic oligonucleotide
gttcttgggcctaaaggtga

SEQ ID NO: 403 - DNA, 20 bp, Artificial sequence
  Synthetic oligonucleotide
attagcagtagctcaggaga

SEQ ID NO: 404 - DNA, 20 bp, Artificial sequence
  Synthetic oligonucleotide
ctggtccagggagagaccaa

SEQ ID NO: 405 - DNA, 20 bp, Artificial sequence
  Synthetic oligonucleotide
agagggttccatggcacaaa

SEQ ID NO: 406 - DNA, 20 bp, Artificial sequence
  Synthetic oligonucleotide
aatttccttacagggtattg

SEQ ID NO: 407 - DNA, 20 bp, Artificial sequence
  Synthetic oligonucleotide
tcatgagaagcttagaaggc

SEQ ID NO: 408 - DNA, 20 bp, Artificial sequence
  Synthetic oligonucleotide
caacaggctctggttccatg

SEQ ID NO: 409 - DNA, 20 bp, Artificial sequence
  Synthetic oligonucleotide
caggccccactgcttagagg

SEQ ID NO: 410 - DNA, 20 bp, Artificial sequence
  Synthetic oligonucleotide
aaatggtagccccttgttgc

SEQ ID NO: 411 - DNA, 20 bp, Artificial sequence
  Synthetic oligonucleotide
tttcccatgggagaagataa

SEQ ID NO: 412 - DNA, 20 bp, Artificial sequence
  Synthetic oligonucleotide
agcgcagagcccatcagcct

SEQ ID NO: 413 - DNA, 20 bp, Artificial sequence
  Synthetic oligonucleotide
cagggtgactttgccccatt

SEQ ID NO: 414 - DNA, 20 bp, Artificial sequence
  Synthetic oligonucleotide
tggcactaagctaggcacac

SEQ ID NO: 415 - DNA, 20 bp, Artificial sequence
  Synthetic oligonucleotide
agggaggccttgcacttacc

SEQ ID NO: 416 - DNA, 20 bp, Artificial sequence
  Synthetic oligonucleotide
tgaggcccttcagcttgtgc

SEQ ID NO: 417 - DNA, 20 bp, Artificial sequence
  Synthetic oligonucleotide
aaaccctcgactgagtgtga

SEQ ID NO: 418 - DNA, 20 bp, Artificial sequence
  Synthetic oligonucleotide
ccttccagggaataaaatac

SEQ ID NO: 419 - DNA, 20 bp, Artificial sequence
  Synthetic oligonucleotide
ccaccttccagggaataaaa

SEQ ID NO: 420 - DNA, 20 bp, Artificial sequence
  Synthetic oligonucleotide
ctgccaccttccagggaata

SEQ ID NO: 421 - DNA, 20 bp, Artificial sequence
  Synthetic oligonucleotide
aacactcacagcactttacc

SEQ ID NO: 422 - DNA, 20 bp, Artificial sequence
  Synthetic oligonucleotide
tggatactcagaagagcagt

SEQ ID NO: 423 - DNA, 20 bp, Artificial sequence
  Synthetic oligonucleotide
cagagttatcctcaattcac

SEQ ID NO: 424 - DNA, 20 bp, Artificial sequence
  Synthetic oligonucleotide
acaccaggatctcagtcact

SEQ ID NO: 425 - DNA, 20 bp, Artificial sequence
  Synthetic oligonucleotide
gcctggacaagtcctgccca

SEQ ID NO: 426 - DNA, 20 bp, Artificial sequence
  Synthetic oligonucleotide
gaaacaggcagtaggaaatc

SEQ ID NO: 427 - DNA, 20 bp, Artificial sequence
  Synthetic oligonucleotide
atggagtgacagggcaggaa

SEQ ID NO: 428 - DNA, 20 bp, Artificial sequence
  Synthetic oligonucleotide
aggccacagtggcaacagag

SEQ ID NO: 429 - DNA, 20 bp, Artificial sequence
  Synthetic oligonucleotide
gttcttttggaagggtggag

SEQ ID NO: 430 - DNA, 20 bp, Artificial sequence
  Synthetic oligonucleotide
ggagccctcacagggccagg

SEQ ID NO: 431 - DNA, 20 bp, Artificial sequence
  Synthetic oligonucleotide
ggacaggagggtcacacaca

SEQ ID NO: 432 - DNA, 20 bp, Artificial sequence
  Synthetic oligonucleotide
agatggacaggtgattctaa

SEQ ID NO: 433 - DNA, 20 bp, Artificial sequence
  Synthetic oligonucleotide
ttaagctttgtgaccttggg

SEQ ID NO: 434 - DNA, 20 bp, Artificial sequence
  Synthetic oligonucleotide
gggaaggataccgccaatga

SEQ ID NO: 435 - DNA, 20 bp, Artificial sequence
  Synthetic oligonucleotide
cagtgggccccaggtggctc

SEQ ID NO: 436 - DNA, 20 bp, Artificial sequence
  Synthetic oligonucleotide
ggtgggaaacttggaaactt

SEQ ID NO: 437 - DNA, 20 bp, Artificial sequence
  Synthetic oligonucleotide
acaattcctggataacaagg

SEQ ID NO: 438 - DNA, 20 bp, Artificial sequence
  Synthetic oligonucleotide
tagaaatacaattcctggat

SEQ ID NO: 439 - DNA, 20 bp, Artificial sequence
  Synthetic oligonucleotide
tgtccttatcaaaatccctc

SEQ ID NO: 440 - DNA, 20 bp, Artificial sequence
  Synthetic oligonucleotide
gctgagagagacaatgagta

SEQ ID NO: 441 - DNA, 20 bp, Artificial sequence
  Synthetic oligonucleotide
gattattctaaaactcaaat

SEQ ID NO: 442 - DNA, 20 bp, Artificial sequence
  Synthetic oligonucleotide
accagctgcaaggatgacct

SEQ ID NO: 443 - DNA, 20 bp, Artificial sequence
  Synthetic oligonucleotide
gaggctcaggccttgacaac

SEQ ID NO: 444 - DNA, 20 bp, Artificial sequence
  Synthetic oligonucleotide
tgttatccgagttgaattct

SEQ ID NO: 445 - DNA, 20 bp, Artificial sequence
  Synthetic oligonucleotide
gttttgggaactcatgcatt

SEQ ID NO: 446 - DNA, 20 bp, Artificial sequence
  Synthetic oligonucleotide
cagctaatgatacaaggttg

SEQ ID NO: 447 - DNA, 20 bp, Artificial sequence
  Synthetic oligonucleotide
gctattcatttttctgagcc

SEQ ID NO: 448 - DNA, 20 bp, Artificial sequence
  Synthetic oligonucleotide
agaggccctggacactggcc

SEQ ID NO: 449 - DNA, 20 bp, Artificial sequence
  Synthetic oligonucleotide
tcagcctagaggccctggac

SEQ ID NO: 450 - DNA, 20 bp, Artificial sequence
  Synthetic oligonucleotide
ccaacagtggtgatgggctt

SEQ ID NO: 451 - DNA, 20 bp, Artificial sequence
  Synthetic oligonucleotide
gcttaccaacagtggtgatg

SEQ ID NO: 452 - DNA, 20 bp, Artificial sequence
  Synthetic oligonucleotide
ccactggagcactgagatga

SEQ ID NO: 453 - DNA, 20 bp, Artificial sequence
  Synthetic oligonucleotide
cccactggagcactgagatg

SEQ ID NO: 454 - DNA, 20 bp, Artificial sequence
  Synthetic oligonucleotide
acccactggagcactgagat

SEQ ID NO: 455 - DNA, 20 bp, Artificial sequence
  Synthetic oligonucleotide
gacccactggagcactgaga

SEQ ID NO: 456 - DNA, 20 bp, Artificial sequence
  Synthetic oligonucleotide
ggacccactggagcactgag

SEQ ID NO: 457 - DNA, 20 bp, Artificial sequence
  Synthetic oligonucleotide
caggacccactggagcactg

SEQ ID NO: 458 - DNA, 20 bp, Artificial sequence
  Synthetic oligonucleotide
acaggacccactggagcact

SEQ ID NO: 459 - DNA, 20 bp, Artificial sequence
  Synthetic oligonucleotide
tttcggacccactgtgacct

SEQ ID NO: 460 - DNA, 20 bp, Artificial sequence
  Synthetic oligonucleotide
gtttcggacccactgtgacc

SEQ ID NO: 461 - DNA, 20 bp, Artificial sequence
  Synthetic oligonucleotide
agtttcggacccactgtgac

SEQ ID NO: 462 - DNA, 20 bp, Artificial sequence
  Synthetic oligonucleotide
ccagtttcggacccactgtg

SEQ ID NO: 463 - DNA, 20 bp, Artificial sequence
  Synthetic oligonucleotide
cccagtttcggacccactgt

SEQ ID NO: 464 - DNA, 20 bp, Artificial sequence
  Synthetic oligonucleotide
tggacaagtcctgcccatct

SEQ ID NO: 465 - DNA, 20 bp, Artificial sequence
  Synthetic oligonucleotide
ctggacaagtcctgcccatc

SEQ ID NO: 466 - DNA, 20 bp, Artificial sequence
  Synthetic oligonucleotide
cctggacaagtcctgcccat

SEQ ID NO: 467 - DNA, 20 bp, Artificial sequence
  Synthetic oligonucleotide
agcctggacaagtcctgccc

SEQ ID NO: 468 - DNA, 20 bp, Artificial sequence
  Synthetic oligonucleotide
cagcctggacaagtcctgcc

SEQ ID NO: 469 - DNA, 20 bp, Artificial sequence
  Synthetic oligonucleotide
gcagcctggacaagtcctgc

SEQ ID NO: 470 - DNA, 20 bp, Artificial sequence
  Synthetic oligonucleotide
tgcagcctggacaagtcctg

SEQ ID NO: 471 - DNA, 20 bp, Artificial sequence
  Synthetic oligonucleotide
caggaccccggagtaggcgg

SEQ ID NO: 472 - DNA, 20 bp, Artificial sequence
  Synthetic oligonucleotide
gcaggaccccggagtaggcg

SEQ ID NO: 473 - DNA, 20 bp, Artificial sequence
  Synthetic oligonucleotide
gcgcaggaccccggagtagg

SEQ ID NO: 474 - DNA, 20 bp, Artificial sequence
  Synthetic oligonucleotide
cgcgcaggaccccggagtag

SEQ ID NO: 475 - DNA, 20 bp, Artificial sequence
  Synthetic oligonucleotide
ccgcgcaggaccccggagta

SEQ ID NO: 476 - DNA, 20 bp, Artificial sequence
  Synthetic oligonucleotide
aggtaaggccgtatgcctgg

SEQ ID NO: 477 - DNA, 20 bp, Artificial sequence
  Synthetic oligonucleotide
caggtaaggccgtatgcctg

SEQ ID NO: 478 - DNA, 20 bp, Artificial sequence
  Synthetic oligonucleotide
gccaggtaaggccgtatgcc

SEQ ID NO: 479 - DNA, 20 bp, Artificial sequence
  Synthetic oligonucleotide
agccaggtaaggccgtatgc

SEQ ID NO: 480 - DNA, 20 bp, Artificial sequence
  Synthetic oligonucleotide
attgccactcccattctttg

SEQ ID NO: 481 - DNA, 20 bp, Artificial sequence
  Synthetic oligonucleotide
cattgccactcccattcttt

SEQ ID NO: 482 - DNA, 20 bp, Artificial sequence
  Synthetic oligonucleotide
agcattgccactcccattct

SEQ ID NO: 483 - DNA, 20 bp, Artificial sequence
  Synthetic oligonucleotide
tagcattgccactcccattc

SEQ ID NO: 484 - DNA, 20 bp, Artificial sequence
  Synthetic oligonucleotide
atagcattgccactcccatt

SEQ ID NO: 485 - DNA, 20 bp, Artificial sequence
  Synthetic oligonucleotide
gatagcattgccactcccat

SEQ ID NO: 486 - DNA, 20 bp, Artificial sequence
  Synthetic oligonucleotide
tgatagcattgccactccca

SEQ ID NO: 487 - DNA, 20 bp, Artificial sequence
  Synthetic oligonucleotide
ctcagagactcagccgcacc

SEQ ID NO: 488 - DNA, 20 bp, Artificial sequence
  Synthetic oligonucleotide
gctcagagactcagccgcac

SEQ ID NO: 489 - DNA, 20 bp, Artificial sequence
  Synthetic oligonucleotide
gagctcagagactcagccgc

SEQ ID NO: 490 - DNA, 20 bp, Artificial sequence
  Synthetic oligonucleotide
ggagctcagagactcagccg

SEQ ID NO: 491 - DNA, 20 bp, Artificial sequence
  Synthetic oligonucleotide
atggagctcagagactcagc

SEQ ID NO: 492 - DNA, 20 bp, Artificial sequence
  Synthetic oligonucleotide
catggagctcagagactcag

SEQ ID NO: 493 - DNA, 20 bp, Artificial sequence
  Synthetic oligonucleotide
gcatggagctcagagactca

SEQ ID NO: 494 - DNA, 20 bp, Artificial sequence
  Synthetic oligonucleotide
ggcatggagctcagagactc

SEQ ID NO: 495 - DNA, 20 bp, Artificial sequence
  Synthetic oligonucleotide
caggcatggagctcagagac

SEQ ID NO: 496 - DNA, 20 bp, Artificial sequence
  Synthetic oligonucleotide
accccatctcccagacccct

SEQ ID NO: 497 - DNA, 20 bp, Artificial sequence
  Synthetic oligonucleotide
cactcaccccatctcccaga

SEQ ID NO: 498 - DNA, 20 bp, Artificial sequence
  Synthetic oligonucleotide
caggtccataacccctgcgc

SEQ ID NO: 499 - DNA, 20 bp, Artificial sequence
  Synthetic oligonucleotide
tctcgcaggtccataacccc

SEQ ID NO: 500 - DNA, 20 bp, Artificial sequence
  Synthetic oligonucleotide
aatcttctcgcaggtccata

SEQ ID NO: 501 - DNA, 20 bp, Artificial sequence
  Synthetic oligonucleotide
cagaaaatcttctcgcaggt

SEQ ID NO: 502 - DNA, 20 bp, Artificial sequence
  Synthetic oligonucleotide
ctttccagaaaatcttctcg

SEQ ID NO: 503 - DNA, 20 bp, Artificial sequence
  Synthetic oligonucleotide
gggccctttccagaaaatct

SEQ ID NO: 504 - DNA, 20 bp, Artificial sequence
  Synthetic oligonucleotide
ccacagggccctttccagaa

SEQ ID NO: 505 - DNA, 20 bp, Artificial sequence
  Synthetic oligonucleotide
gcctgccacagggccctttc

SEQ ID NO: 506 - DNA, 20 bp, Artificial sequence
  Synthetic oligonucleotide
caccagcctgccacagggcc

SEQ ID NO: 507 - DNA, 20 bp, Artificial sequence
  Synthetic oligonucleotide
cacggatgagggaaacaagc

SEQ ID NO: 508 - DNA, 20 bp, Artificial sequence
  Synthetic oligonucleotide
aatatccctaataactaaga

SEQ ID NO: 509 - DNA, 20 bp, Artificial sequence
  Synthetic oligonucleotide
tctcgaatatccctaataac

SEQ ID NO: 510 - DNA, 20 bp, Artificial sequence
  Synthetic oligonucleotide
ggagttctcgaatatcccta

SEQ ID NO: 511 - DNA, 20 bp, Artificial sequence
  Synthetic oligonucleotide
aaacccataccatcctgccc

SEQ ID NO: 512 - DNA, 20 bp, Artificial sequence
  Synthetic oligonucleotide
tggtggctgtctcaggagac

SEQ ID NO: 513 - DNA, 20 bp, Artificial sequence
  Synthetic oligonucleotide
ccgtctggtggctgtctcag

SEQ ID NO: 514 - DNA, 20 bp, Artificial sequence
  Synthetic oligonucleotide
ggcagacacacctgttccag

SEQ ID NO: 515 - DNA, 20 bp, Artificial sequence
  Synthetic oligonucleotide
gacagggcagacacacctgt

SEQ ID NO: 516 - DNA, 20 bp, Artificial sequence
  Synthetic oligonucleotide
cagaggacagggcagacaca

SEQ ID NO: 517 - DNA, 20 bp, Artificial sequence
  Synthetic oligonucleotide
ccagagcctgggcgagagga

SEQ ID NO: 518 - DNA, 20 bp, Artificial sequence
  Synthetic oligonucleotide
cagggtcctctccgctgcct

SEQ ID NO: 519 - DNA, 20 bp, Artificial sequence
  Synthetic oligonucleotide
ctgaggacctcagttctacc

SEQ ID NO: 520 - DNA, 20 bp, Artificial sequence
  Synthetic oligonucleotide
attcactgaggacctcagtt

SEQ ID NO: 521 - DNA, 20 bp, Artificial sequence
  Synthetic oligonucleotide
gcgcgattcactgaggacct

SEQ ID NO: 522 - DNA, 20 bp, Artificial sequence
  Synthetic oligonucleotide
actctgcgcgattcactgag

SEQ ID NO: 523 - DNA, 20 bp, Artificial sequence
  Synthetic oligonucleotide
ctcccacttcagtttctcca

SEQ ID NO: 524 - DNA, 20 bp, Artificial sequence
  Synthetic oligonucleotide
gcttcctcccacttcagttt

SEQ ID NO: 525 - DNA, 20 bp, Artificial sequence
  Synthetic oligonucleotide
ggcatgcttcctcccacttc

SEQ ID NO: 526 - DNA, 20 bp, Artificial sequence
  Synthetic oligonucleotide
acttaggcatgcttcctccc

SEQ ID NO: 527 - DNA, 20 bp, Artificial sequence
  Synthetic oligonucleotide
ggaaaacttaggcatgcttc

SEQ ID NO: 528 - DNA, 20 bp, Artificial sequence
  Synthetic oligonucleotide
gctaaggaaaacttaggcat

SEQ ID NO: 529 - DNA, 20 bp, Artificial sequence
  Synthetic oligonucleotide
catcagctaaggaaaactta

SEQ ID NO: 530 - DNA, 20 bp, Artificial sequence
  Synthetic oligonucleotide
caaggcatcagctaaggaaa

SEQ ID NO: 531 - DNA, 20 bp, Artificial sequence
  Synthetic oligonucleotide
atttgtacttgaatccaggg

SEQ ID NO: 532 - DNA, 20 bp, Artificial sequence
  Synthetic oligonucleotide
gtgatgacttcccagggtct

SEQ ID NO: 533 - DNA, 20 bp, Artificial sequence
  Synthetic oligonucleotide
cagctgtgatgacttcccag

SEQ ID NO: 534 - DNA, 20 bp, Artificial sequence
  Synthetic oligonucleotide
caggacagctgtgatgactt

SEQ ID NO: 535 - DNA, 20 bp, Artificial sequence
  Synthetic oligonucleotide
cagaccaggacagctgtgat

SEQ ID NO: 536 - DNA, 20 bp, Artificial sequence
  Synthetic oligonucleotide
cacacgcagaccaggacagc

SEQ ID NO: 537 - DNA, 20 bp, Artificial sequence
  Synthetic oligonucleotide
agacacacacgcagaccagg

SEQ ID NO: 538 - DNA, 20 bp, Artificial sequence
  Synthetic oligonucleotide
atgcaagacacacacgcaga

SEQ ID NO: 539 - DNA, 20 bp, Artificial sequence
  Synthetic oligonucleotide
gcttcatgcaagacacacac

SEQ ID NO: 540 - DNA, 20 bp, Artificial sequence
  Synthetic oligonucleotide
atgtcagagaggctcagcaa

SEQ ID NO: 541 - DNA, 20 bp, Artificial sequence
  Synthetic oligonucleotide
aatccatgtcagagaggctc

SEQ ID NO: 542 - DNA, 20 bp, Artificial sequence
  Synthetic oligonucleotide
agaaaaatccatgtcagaga

SEQ ID NO: 543 - DNA, 20 bp, Artificial sequence
  Synthetic oligonucleotide
actaaagaaaaatccatgtc

SEQ ID NO: 544 - DNA, 20 bp, Artificial sequence
  Synthetic oligonucleotide
tagttactaaagaaaaatcc

SEQ ID NO: 545 - DNA, 20 bp, Artificial sequence
  Synthetic oligonucleotide
ggatagtcgatttaccagaa

SEQ ID NO: 546 - DNA, 20 bp, Artificial sequence
  Synthetic oligonucleotide
tctttggatagtcgatttac

SEQ ID NO: 547 - DNA, 20 bp, Artificial sequence
  Synthetic oligonucleotide
actaaaatgctaataggaag

SEQ ID NO: 548 - DNA, 20 bp, Artificial sequence
  Synthetic oligonucleotide
gatatactaaaatgctaata

SEQ ID NO: 549 - DNA, 20 bp, Artificial sequence
  Synthetic oligonucleotide
caagagatatactaaaatgc

SEQ ID NO: 550 - DNA, 20 bp, Artificial sequence
  Synthetic oligonucleotide
atgatcaagagatatactaa

SEQ ID NO: 551 - DNA, 20 bp, Artificial sequence
  Synthetic oligonucleotide
agaaaatgatcaagagatat

SEQ ID NO: 552 - DNA, 20 bp, Artificial sequence
  Synthetic oligonucleotide
tataaagaaaatgatcaaga

SEQ ID NO: 553 - DNA, 20 bp, Artificial sequence
  Synthetic oligonucleotide
atgtgtataaagaaaatgat

SEQ ID NO: 554 - DNA, 20 bp, Artificial sequence
  Synthetic oligonucleotide
atgcaatgtgtataaagaaa

SEQ ID NO: 555 - DNA, 20 bp, Artificial sequence
  Synthetic oligonucleotide
tatctatgcaatgtgtataa

SEQ ID NO: 556 - DNA, 20 bp, Artificial sequence
  Synthetic oligonucleotide
attcataactatatctacag

SEQ ID NO: 557 - DNA, 20 bp, Artificial sequence
  Synthetic oligonucleotide
acaagattcataactatatc

SEQ ID NO: 558 - DNA, 20 bp, Artificial sequence
  Synthetic oligonucleotide
agaaaacaagattcataact

SEQ ID NO: 559 - DNA, 20 bp, Artificial sequence
  Synthetic oligonucleotide
cctcgatgttacattaaggg

SEQ ID NO: 560 - DNA, 20 bp, Artificial sequence
  Synthetic oligonucleotide
ggaaacctcgatgttacatt

SEQ ID NO: 561 - DNA, 20 bp, Artificial sequence
  Synthetic oligonucleotide
attgcaaccactaggacatt

SEQ ID NO: 562 - DNA, 20 bp, Artificial sequence
  Synthetic oligonucleotide
gggttattgcaaccactagg

SEQ ID NO: 563 - DNA, 20 bp, Artificial sequence
  Synthetic oligonucleotide
cacagttaaagtgtggtaca

SEQ ID NO: 564 - DNA, 20 bp, Artificial sequence
  Synthetic oligonucleotide
taggtcacagttaaagtgtg

SEQ ID NO: 565 - DNA, 20 bp, Artificial sequence
  Synthetic oligonucleotide
atgcctaggtcacagttaaa

SEQ ID NO: 566 - DNA, 20 bp, Artificial sequence
  Synthetic oligonucleotide
tgccaatgcctaggtcacag

SEQ ID NO: 567 - DNA, 20 bp, Artificial sequence
  Synthetic oligonucleotide
agcaatgccaatgcctaggt

SEQ ID NO: 568 - DNA, 20 bp, Artificial sequence
  Synthetic oligonucleotide
cacagcgataatcacacaag

SEQ ID NO: 569 - DNA, 20 bp, Artificial sequence
  Synthetic oligonucleotide
acggccccgcgggaagccgc

SEQ ID NO: 570 - DNA, 20 bp, Artificial sequence
  Synthetic oligonucleotide
cagtcacggccccgcgggaa

SEQ ID NO: 571 - DNA, 20 bp, Artificial sequence
  Synthetic oligonucleotide
ccgcccagtcacggccccgc

SEQ ID NO: 572 - DNA, 20 bp, Artificial sequence
  Synthetic oligonucleotide
gaagcccgcccagtcacggc

SEQ ID NO: 573 - DNA, 20 bp, Artificial sequence
  Synthetic oligonucleotide
gacacctggagctgcggccg

SEQ ID NO: 574 - DNA, 20 bp, Artificial sequence
  Synthetic oligonucleotide
ggacacctggagctgcggcc

SEQ ID NO: 575 - DNA, 20 bp, Artificial sequence
  Synthetic oligonucleotide
aggacacctggagctgcggc

SEQ ID NO: 576 - DNA, 20 bp, Artificial sequence
  Synthetic oligonucleotide
taggacacctggagctgcgg

SEQ ID NO: 577 - DNA, 20 bp, Artificial sequence
  Synthetic oligonucleotide
gctaggacacctggagctgc

SEQ ID NO: 578 - DNA, 20 bp, Artificial sequence
  Synthetic oligonucleotide
ggctaggacacctggagctg

SEQ ID NO: 579 - DNA, 20 bp, Artificial sequence
  Synthetic oligonucleotide
cagggcttcgcgcagagcac

SEQ ID NO: 580 - DNA, 20 bp, Artificial sequence
  Synthetic oligonucleotide
ccagggcttcgcgcagagca

SEQ ID NO: 581 - DNA, 20 bp, Artificial sequence
  Synthetic oligonucleotide
ggccagggcttcgcgcagag

SEQ ID NO: 582 - DNA, 20 bp, Artificial sequence
  Synthetic oligonucleotide
tgagggtcttcatggctgaa

SEQ ID NO: 583 - DNA, 20 bp, Artificial sequence
  Synthetic oligonucleotide
tatgagggtcttcatggctg

SEQ ID NO: 584 - DNA, 20 bp, Artificial sequence
  Synthetic oligonucleotide
ctatgagggtcttcatggct

SEQ ID NO: 585 - DNA, 20 bp, Artificial sequence
  Synthetic oligonucleotide
gctatgagggtcttcatggc

SEQ ID NO: 586 - DNA, 20 bp, Artificial sequence
  Synthetic oligonucleotide
cggctatgagggtcttcatg

SEQ ID NO: 587 - DNA, 20 bp, Artificial sequence
  Synthetic oligonucleotide
gcggctatgagggtcttcat

SEQ ID NO: 588 - DNA, 20 bp, Artificial sequence
  Synthetic oligonucleotide
ggcggctatgagggtcttca

SEQ ID NO: 589 - DNA, 20 bp, Artificial sequence
  Synthetic oligonucleotide
aggcggctatgagggtcttc

SEQ ID NO: 590 - DNA, 20 bp, Artificial sequence
  Synthetic oligonucleotide
gtaggcggctatgagggtct

SEQ ID NO: 591 - DNA, 20 bp, Artificial sequence
  Synthetic oligonucleotide
agtaggcggctatgagggtc

SEQ ID NO: 592 - DNA, 20 bp, Artificial sequence
  Synthetic oligonucleotide
ggagtaggcggctatgaggg

SEQ ID NO: 593 - DNA, 20 bp, Artificial sequence
  Synthetic oligonucleotide
cggagtaggcggctatgagg

SEQ ID NO: 594 - DNA, 20 bp, Artificial sequence
  Synthetic oligonucleotide
cccggagtaggcggctatga

SEQ ID NO: 595 - DNA, 20 bp, Artificial sequence
  Synthetic oligonucleotide
ccccggagtaggcggctatg

SEQ ID NO: 596 - DNA, 20 bp, Artificial sequence
  Synthetic oligonucleotide
gaccccggagtaggcggcta

SEQ ID NO: 597 - DNA, 20 bp, Artificial sequence
  Synthetic oligonucleotide
ggaccccggagtaggcggct

SEQ ID NO: 598 - DNA, 20 bp, Artificial sequence
  Synthetic oligonucleotide
cggtcagcctcggcctgacg

SEQ ID NO: 599 - DNA, 20 bp, Artificial sequence
  Synthetic oligonucleotide
ccggtcagcctcggcctgac

SEQ ID NO: 600 - DNA, 20 bp, Artificial sequence
  Synthetic oligonucleotide
ctccggtcagcctcggcctg

SEQ ID NO: 601 - DNA, 20 bp, Artificial sequence
  Synthetic oligonucleotide
gctccggtcagcctcggcct

SEQ ID NO: 602 - DNA, 20 bp, Artificial sequence
  Synthetic oligonucleotide
tggctccggtcagcctcggc

SEQ ID NO: 603 - DNA, 20 bp, Artificial sequence
  Synthetic oligonucleotide
ctggctccggtcagcctcgg

SEQ ID NO: 604 - DNA, 20 bp, Artificial sequence
  Synthetic oligonucleotide
gctggctccggtcagcctcg

SEQ ID NO: 605 - DNA, 20 bp, Artificial sequence
  Synthetic oligonucleotide
cgctggctccggtcagcctc

SEQ ID NO: 606 - DNA, 20 bp, Artificial sequence
  Synthetic oligonucleotide
gcgctggctccggtcagcct

SEQ ID NO: 607 - DNA, 20 bp, Artificial sequence
  Synthetic oligonucleotide
gcaggtcctccgtgagagcg

SEQ ID NO: 608 - DNA, 20 bp, Artificial sequence
  Synthetic oligonucleotide
cgcaggtcctccgtgagagc

SEQ ID NO: 609 - DNA, 20 bp, Artificial sequence
  Synthetic oligonucleotide
gcgcaggtcctccgtgagag

SEQ ID NO: 610 - DNA, 20 bp, Artificial sequence
  Synthetic oligonucleotide
agcgcaggtcctccgtgaga

SEQ ID NO: 611 - DNA, 20 bp, Artificial sequence
  Synthetic oligonucleotide
cagcgcaggtcctccgtgag

SEQ ID NO: 612 - DNA, 20 bp, Artificial sequence
  Synthetic oligonucleotide
acagcgcaggtcctccgtga

SEQ ID NO: 613 - DNA, 20 bp, Artificial sequence
  Synthetic oligonucleotide
gacagcgcaggtcctccgtg

SEQ ID NO: 614 - DNA, 20 bp, Artificial sequence
  Synthetic oligonucleotide
gcgacagcgcaggtcctccg

SEQ ID NO: 615 - DNA, 20 bp, Artificial sequence
  Synthetic oligonucleotide
cgcgacagcgcaggtcctcc

SEQ ID NO: 616 - DNA, 20 bp, Artificial sequence
  Synthetic oligonucleotide
gcgcgacagcgcaggtcctc

SEQ ID NO: 617 - DNA, 20 bp, Artificial sequence
  Synthetic oligonucleotide
cgcgcgacagcgcaggtcct

SEQ ID NO: 618 - DNA, 20 bp, Artificial sequence
  Synthetic oligonucleotide
tcgcgcgacagcgcaggtcc

SEQ ID NO: 619 - DNA, 20 bp, Artificial sequence
  Synthetic oligonucleotide
ctcgcgcgacagcgcaggtc

SEQ ID NO: 620 - DNA, 20 bp, Artificial sequence
  Synthetic oligonucleotide
cctcgcgcgacagcgcaggt

SEQ ID NO: 621 - DNA, 20 bp, Artificial sequence
  Synthetic oligonucleotide
ccctcgcgcgacagcgcagg

SEQ ID NO: 622 - DNA, 20 bp, Artificial sequence
  Synthetic oligonucleotide
acccctcgcgcgacagcgca

SEQ ID NO: 623 - DNA, 20 bp, Artificial sequence
  Synthetic oligonucleotide
gacccctcgcgcgacagcgc

SEQ ID NO: 624 - DNA, 20 bp, Artificial sequence
  Synthetic oligonucleotide
agacccctcgcgcgacagcg

SEQ ID NO: 625 - DNA, 20 bp, Artificial sequence
  Synthetic oligonucleotide
cagacccctcgcgcgacagc

SEQ ID NO: 626 - DNA, 20 bp, Artificial sequence
  Synthetic oligonucleotide
ccagacccctcgcgcgacag

SEQ ID NO: 627 - DNA, 20 bp, Artificial sequence
  Synthetic oligonucleotide
cccagacccctcgcgcgaca

SEQ ID NO: 628 - DNA, 20 bp, Artificial sequence
  Synthetic oligonucleotide
ctcccagacccctcgcgcga

SEQ ID NO: 629 - DNA, 20 bp, Artificial sequence
  Synthetic oligonucleotide
tctcccagacccctcgcgcg

SEQ ID NO: 630 - DNA, 20 bp, Artificial sequence
  Synthetic oligonucleotide
atctcccagacccctcgcgc

SEQ ID NO: 631 - DNA, 20 bp, Artificial sequence
  Synthetic oligonucleotide
catctcccagacccctcgcg

SEQ ID NO: 632 - DNA, 20 bp, Artificial sequence
  Synthetic oligonucleotide
ccatctcccagacccctcgc

SEQ ID NO: 633 - DNA, 20 bp, Artificial sequence
  Synthetic oligonucleotide
ccccatctcccagacccctc

SEQ ID NO: 634 - DNA, 20 bp, Artificial sequence
  Synthetic oligonucleotide
gccccatctcccagacccct

SEQ ID NO: 635 - DNA, 20 bp, Artificial sequence
  Synthetic oligonucleotide
tgccccatctcccagacccc

SEQ ID NO: 636 - DNA, 20 bp, Artificial sequence
  Synthetic oligonucleotide
gtgccccatctcccagaccc

SEQ ID NO: 637 - DNA, 20 bp, Artificial sequence
  Synthetic oligonucleotide
agtgccccatctcccagacc

SEQ ID NO: 638 - DNA, 20 bp, Artificial sequence
  Synthetic oligonucleotide
ccagtgccccatctcccaga

SEQ ID NO: 639 - DNA, 20 bp, Artificial sequence
  Synthetic oligonucleotide
tccagtgccccatctcccag

SEQ ID NO: 640 - DNA, 20 bp, Artificial sequence
  Synthetic oligonucleotide
gatccagtgccccatctccc

SEQ ID NO: 641 - DNA, 20 bp, Artificial sequence
  Synthetic oligonucleotide
ggatccagtgccccatctcc

SEQ ID NO: 642 - DNA, 20 bp, Artificial sequence
  Synthetic oligonucleotide
ctggatccagtgccccatct

SEQ ID NO: 643 - DNA, 20 bp, Artificial sequence
  Synthetic oligonucleotide
gctggatccagtgccccatc

SEQ ID NO: 644 - DNA, 20 bp, Artificial sequence
  Synthetic oligonucleotide
atgctggatccagtgcccca

SEQ ID NO: 645 - DNA, 20 bp, Artificial sequence
  Synthetic oligonucleotide
gatgctggatccagtgcccc

SEQ ID NO: 646 - DNA, 20 bp, Artificial sequence
  Synthetic oligonucleotide
aggatgctggatccagtgcc

SEQ ID NO: 647 - DNA, 20 bp, Artificial sequence
  Synthetic oligonucleotide
gaggatgctggatccagtgc

SEQ ID NO: 648 - DNA, 20 bp, Artificial sequence
  Synthetic oligonucleotide
gagaggatgctggatccagt

SEQ ID NO: 649 - DNA, 20 bp, Artificial sequence
  Synthetic oligonucleotide
acttctgtggcctctgtgct

SEQ ID NO: 650 - DNA, 20 bp, Artificial sequence
  Synthetic oligonucleotide
tcacttctgtggcctctgtg

SEQ ID NO: 651 - DNA, 20 bp, Artificial sequence
  Synthetic oligonucleotide
ctcacttctgtggcctctgt

SEQ ID NO: 652 - DNA, 20 bp, Artificial sequence
  Synthetic oligonucleotide
tgctcacttctgtggcctct

SEQ ID NO: 653 - DNA, 20 bp, Artificial sequence
  Synthetic oligonucleotide
ttgctcacttctgtggcctc

SEQ ID NO: 654 - DNA, 20 bp, Artificial sequence
  Synthetic oligonucleotide
tcttgctcacttctgtggcc

SEQ ID NO: 655 - DNA, 20 bp, Artificial sequence
  Synthetic oligonucleotide
ttcttgctcacttctgtggc

SEQ ID NO: 656 - DNA, 20 bp, Artificial sequence
  Synthetic oligonucleotide
acttcttgctcacttctgtg

SEQ ID NO: 657 - DNA, 20 bp, Artificial sequence
  Synthetic oligonucleotide
aacttcttgctcacttctgt

SEQ ID NO: 658 - DNA, 20 bp, Artificial sequence
  Synthetic oligonucleotide
ggaacttcttgctcacttct

SEQ ID NO: 659 - DNA, 20 bp, Artificial sequence
  Synthetic oligonucleotide
gggaacttcttgctcacttc

SEQ ID NO: 660 - DNA, 20 bp, Artificial sequence
  Synthetic oligonucleotide
ctgggaacttcttgctcact

SEQ ID NO: 661 - DNA, 20 bp, Artificial sequence
  Synthetic oligonucleotide
cctgggaacttcttgctcac

SEQ ID NO: 662 - DNA, 20 bp, Artificial sequence
  Synthetic oligonucleotide
tgcctgggaacttcttgctc

SEQ ID NO: 663 - DNA, 20 bp, Artificial sequence
  Synthetic oligonucleotide
atgcctgggaacttcttgct

SEQ ID NO: 664 - DNA, 20 bp, Artificial sequence
  Synthetic oligonucleotide
gtatgcctgggaacttcttg

SEQ ID NO: 665 - DNA, 20 bp, Artificial sequence
  Synthetic oligonucleotide
cgtatgcctgggaacttctt

SEQ ID NO: 666 - DNA, 20 bp, Artificial sequence
  Synthetic oligonucleotide
ccgtatgcctgggaacttct

SEQ ID NO: 667 - DNA, 20 bp, Artificial sequence
  Synthetic oligonucleotide
ggccgtatgcctgggaactt

SEQ ID NO: 668 - DNA, 20 bp, Artificial sequence
  Synthetic oligonucleotide
aggccgtatgcctgggaact

SEQ ID NO: 669 - DNA, 20 bp, Artificial sequence
  Synthetic oligonucleotide
taaggccgtatgcctgggaa

SEQ ID NO: 670 - DNA, 20 bp, Artificial sequence
  Synthetic oligonucleotide
gtaaggccgtatgcctggga

SEQ ID NO: 671 - DNA, 20 bp, Artificial sequence
  Synthetic oligonucleotide
gtagccaggtaaggccgtat

SEQ ID NO: 672 - DNA, 20 bp, Artificial sequence
  Synthetic oligonucleotide
tgtagccaggtaaggccgta

SEQ ID NO: 673 - DNA, 20 bp, Artificial sequence
  Synthetic oligonucleotide
agtgtagccaggtaaggccg

SEQ ID NO: 674 - DNA, 20 bp, Artificial sequence
  Synthetic oligonucleotide
cagtgtagccaggtaaggcc

SEQ ID NO: 675 - DNA, 20 bp, Artificial sequence
  Synthetic oligonucleotide
ccagtgtagccaggtaaggc

SEQ ID NO: 676 - DNA, 20 bp, Artificial sequence
  Synthetic oligonucleotide
ggtactccctcaacacaggc

SEQ ID NO: 677 - DNA, 20 bp, Artificial sequence
  Synthetic oligonucleotide
aggtactccctcaacacagg

SEQ ID NO: 678 - DNA, 20 bp, Artificial sequence
  Synthetic oligonucleotide
tcaggtactccctcaacaca

SEQ ID NO: 679 - DNA, 20 bp, Artificial sequence
  Synthetic oligonucleotide
atcaggtactccctcaacac

SEQ ID NO: 680 - DNA, 20 bp, Artificial sequence
  Synthetic oligonucleotide
acatcaggtactccctcaac

SEQ ID NO: 681 - DNA, 20 bp, Artificial sequence
  Synthetic oligonucleotide
gacatcaggtactccctcaa

SEQ ID NO: 682 - DNA, 20 bp, Artificial sequence
  Synthetic oligonucleotide
cagacatcaggtactccctc

SEQ ID NO: 683 - DNA, 20 bp, Artificial sequence
  Synthetic oligonucleotide
ccagacatcaggtactccct

SEQ ID NO: 684 - DNA, 20 bp, Artificial sequence
  Synthetic oligonucleotide
tccagacatcaggtactccc

SEQ ID NO: 685 - DNA, 20 bp, Artificial sequence
  Synthetic oligonucleotide
ctccagacatcaggtactcc

SEQ ID NO: 686 - DNA, 20 bp, Artificial sequence
  Synthetic oligonucleotide
gatacctccagacatcaggt

SEQ ID NO: 687 - DNA, 20 bp, Artificial sequence
  Synthetic oligonucleotide
agatacctccagacatcagg

SEQ ID NO: 688 - DNA, 20 bp, Artificial sequence
  Synthetic oligonucleotide
gcagatacctccagacatca

SEQ ID NO: 689 - DNA, 20 bp, Artificial sequence
  Synthetic oligonucleotide
ggcagatacctccagacatc

SEQ ID NO: 690 - DNA, 20 bp, Artificial sequence
  Synthetic oligonucleotide
agggcagatacctccagaca

SEQ ID NO: 691 - DNA, 20 bp, Artificial sequence
  Synthetic oligonucleotide
cagggcagatacctccagac

SEQ ID NO: 692 - DNA, 20 bp, Artificial sequence
  Synthetic oligonucleotide
gacagggcagatacctccag

SEQ ID NO: 693 - DNA, 20 bp, Artificial sequence
  Synthetic oligonucleotide
tgacagggcagatacctcca

SEQ ID NO: 694 - DNA, 20 bp, Artificial sequence
  Synthetic oligonucleotide
aaatagtctatggtgtcccg

SEQ ID NO: 695 - DNA, 20 bp, Artificial sequence
  Synthetic oligonucleotide
caaatagtctatggtgtccc

SEQ ID NO: 696 - DNA, 20 bp, Artificial sequence
  Synthetic oligonucleotide
agcaaatagtctatggtgtc

SEQ ID NO: 697 - DNA, 20 bp, Artificial sequence
  Synthetic oligonucleotide
aagcaaatagtctatggtgt

SEQ ID NO: 698 - DNA, 20 bp, Artificial sequence
  Synthetic oligonucleotide
gaaagcaaatagtctatggt

SEQ ID NO: 699 - DNA, 20 bp, Artificial sequence
  Synthetic oligonucleotide
tgaaagcaaatagtctatgg

SEQ ID NO: 700 - DNA, 20 bp, Artificial sequence
  Synthetic oligonucleotide
tttgaaagcaaatagtctat

SEQ ID NO: 701 - DNA, 20 bp, Artificial sequence
  Synthetic oligonucleotide
ctttgaaagcaaatagtcta

SEQ ID NO: 702 - DNA, 20 bp, Artificial sequence
  Synthetic oligonucleotide
ttctttgaaagcaaatagtc

SEQ ID NO: 703 - DNA, 20 bp, Artificial sequence
  Synthetic oligonucleotide
attctttgaaagcaaatagt

SEQ ID NO: 704 - DNA, 20 bp, Artificial sequence
  Synthetic oligonucleotide
ccattctttgaaagcaaata

SEQ ID NO: 705 - DNA, 20 bp, Artificial sequence
  Synthetic oligonucleotide
cccattctttgaaagcaaat

SEQ ID NO: 706 - DNA, 20 bp, Artificial sequence
  Synthetic oligonucleotide
ctcccattctttgaaagcaa

SEQ ID NO: 707 - DNA, 20 bp, Artificial sequence
  Synthetic oligonucleotide
actcccattctttgaaagca

SEQ ID NO: 708 - DNA, 20 bp, Artificial sequence
  Synthetic oligonucleotide
cactcccattctttgaaagc

SEQ ID NO: 709 - DNA, 20 bp, Artificial sequence
  Synthetic oligonucleotide
gccactcccattctttgaaa

SEQ ID NO: 710 - DNA, 20 bp, Artificial sequence
  Synthetic oligonucleotide
tgccactcccattctttgaa

SEQ ID NO: 711 - DNA, 20 bp, Artificial sequence
  Synthetic oligonucleotide
atgatagcattgccactccc

SEQ ID NO: 712 - DNA, 20 bp, Artificial sequence
  Synthetic oligonucleotide
gatgatagcattgccactcc

SEQ ID NO: 713 - DNA, 20 bp, Artificial sequence
  Synthetic oligonucleotide
tgatgatagcattgccactc

SEQ ID NO: 714 - DNA, 20 bp, Artificial sequence
  Synthetic oligonucleotide
atgatgatagcattgccact

SEQ ID NO: 715 - DNA, 20 bp, Artificial sequence
  Synthetic oligonucleotide
cgatgatgatagcattgcca

SEQ ID NO: 716 - DNA, 20 bp, Artificial sequence
  Synthetic oligonucleotide
acgatgatgatagcattgcc

SEQ ID NO: 717 - DNA, 20 bp, Artificial sequence
  Synthetic oligonucleotide
cacgatgatgatagcattgc

SEQ ID NO: 718 - DNA, 20 bp, Artificial sequence
  Synthetic oligonucleotide
ccacgatgatgatagcattg

SEQ ID NO: 719 - DNA, 20 bp, Artificial sequence
  Synthetic oligonucleotide
agagactcagccgcaccccc

SEQ ID NO: 720 - DNA, 20 bp, Artificial sequence
  Synthetic oligonucleotide
cagagactcagccgcacccc

SEQ ID NO: 721 - DNA, 20 bp, Artificial sequence
  Synthetic oligonucleotide
ccaggcatggagctcagaga

SEQ ID NO: 722 - DNA, 20 bp, Artificial sequence
  Synthetic oligonucleotide
ggagaggatgctggatccag

SEQ ID NO: 723 - DNA, 20 bp, Artificial sequence
  Synthetic oligonucleotide
gcggagaggatgctggatcc

SEQ ID NO: 724 - DNA, 20 bp, Artificial sequence
  Synthetic oligonucleotide
ggcggagaggatgctggatc

SEQ ID NO: 725 - DNA, 20 bp, Artificial sequence
  Synthetic oligonucleotide
agggcggagaggatgctgga

SEQ ID NO: 726 - DNA, 20 bp, Artificial sequence
  Synthetic oligonucleotide
gagggcggagaggatgctgg

SEQ ID NO: 727 - DNA, 20 bp, Artificial sequence
  Synthetic oligonucleotide
ggagggcggagaggatgctg

SEQ ID NO: 728 - DNA, 20 bp, Artificial sequence
  Synthetic oligonucleotide
tggagggcggagaggatgct

SEQ ID NO: 729 - DNA, 20 bp, Artificial sequence
  Synthetic oligonucleotide
cctggagggcggagaggatg

SEQ ID NO: 730 - DNA, 20 bp, Artificial sequence
  Synthetic oligonucleotide
tcctggagggcggagaggat

SEQ ID NO: 731 - DNA, 20 bp, Artificial sequence
  Synthetic oligonucleotide
ggtcctggagggcggagagg

SEQ ID NO: 732 - DNA, 20 bp, Artificial sequence
  Synthetic oligonucleotide
aggtcctggagggcggagag

SEQ ID NO: 733 - DNA, 20 bp, Artificial sequence
  Synthetic oligonucleotide
gaggtcctggagggcggaga

SEQ ID NO: 734 - DNA, 20 bp, Artificial sequence
  Synthetic oligonucleotide
agaggtcctggagggcggag

SEQ ID NO: 735 - DNA, 20 bp, Artificial sequence
  Synthetic oligonucleotide
aagaggtcctggagggcgga

SEQ ID NO: 736 - DNA, 20 bp, Artificial sequence
  Synthetic oligonucleotide
gaagaggtcctggagggcgg

SEQ ID NO: 737 - DNA, 20 bp, Artificial sequence
  Synthetic oligonucleotide
agaagaggtcctggagggcg

SEQ ID NO: 738 - DNA, 20 bp, Artificial sequence
  Synthetic oligonucleotide
ggacctattgagccaggtga

SEQ ID NO: 739 - DNA, 20 bp, Artificial sequence
  Synthetic oligonucleotide
tggacctattgagccaggtg

SEQ ID NO: 740 - DNA, 20 bp, Artificial sequence
  Synthetic oligonucleotide
ttggacctattgagccaggt

SEQ ID NO: 741 - DNA, 20 bp, Artificial sequence
  Synthetic oligonucleotide
cttggacctattgagccagg

SEQ ID NO: 742 - DNA, 20 bp, Artificial sequence
  Synthetic oligonucleotide
accttggacctattgagcca

SEQ ID NO: 743 - DNA, 20 bp, Artificial sequence
  Synthetic oligonucleotide
caccttggacctattgagcc

SEQ ID NO: 744 - DNA, 20 bp, Artificial sequence
  Synthetic oligonucleotide
ccaccttggacctattgagc

SEQ ID NO: 745 - DNA, 20 bp, Artificial sequence
  Synthetic oligonucleotide
tccaccttggacctattgag

SEQ ID NO: 746 - DNA, 20 bp, Artificial sequence
  Synthetic oligonucleotide
tttccaccttggacctattg

SEQ ID NO: 747 - DNA, 20 bp, Artificial sequence
  Synthetic oligonucleotide
ttttccaccttggacctatt

SEQ ID NO: 748 - DNA, 20 bp, Artificial sequence
  Synthetic oligonucleotide
cttttccaccttggacctat

SEQ ID NO: 749 - DNA, 20 bp, Artificial sequence
  Synthetic oligonucleotide
gcttttccaccttggaccta

SEQ ID NO: 750 - DNA, 20 bp, Artificial sequence
  Synthetic oligonucleotide
ctgcttttccaccttggacc

SEQ ID NO: 751 - DNA, 20 bp, Artificial sequence
  Synthetic oligonucleotide
gctgcttttccaccttggac

SEQ ID NO: 752 - DNA, 20 bp, Artificial sequence
  Synthetic oligonucleotide
tagctgcttttccaccttgg

SEQ ID NO: 753 - DNA, 20 bp, Artificial sequence
  Synthetic oligonucleotide
tgtagctgcttttccacctt

SEQ ID NO: 754 - DNA, 20 bp, Artificial sequence
  Synthetic oligonucleotide
ctgtagctgcttttccacct

SEQ ID NO: 755 - DNA, 20 bp, Artificial sequence
  Synthetic oligonucleotide
acctgtagctgcttttccac

SEQ ID NO: 756 - DNA, 20 bp, Artificial sequence
  Synthetic oligonucleotide
gacctgtagctgcttttcca

SEQ ID NO: 757 - DNA, 20 bp, Artificial sequence
  Synthetic oligonucleotide
atgacctgtagctgcttttc

SEQ ID NO: 758 - DNA, 20 bp, Artificial sequence
  Synthetic oligonucleotide
gatgacctgtagctgctttt

SEQ ID NO: 759 - DNA, 20 bp, Artificial sequence
  Synthetic oligonucleotide
agatgacctgtagctgcttt

SEQ ID NO: 760 - DNA, 20 bp, Artificial sequence
  Synthetic oligonucleotide
tgagatgacctgtagctgct

SEQ ID NO: 761 - DNA, 20 bp, Artificial sequence
  Synthetic oligonucleotide
ctgagatgacctgtagctgc

SEQ ID NO: 762 - DNA, 20 bp, Artificial sequence
  Synthetic oligonucleotide
cactgagatgacctgtagct

SEQ ID NO: 763 - DNA, 20 bp, Artificial sequence
  Synthetic oligonucleotide
gcactgagatgacctgtagc

SEQ ID NO: 764 - DNA, 20 bp, Artificial sequence
  Synthetic oligonucleotide
gagcactgagatgacctgta

SEQ ID NO: 765 - DNA, 20 bp, Artificial sequence
  Synthetic oligonucleotide
ggagcactgagatgacctgt

SEQ ID NO: 766 - DNA, 20 bp, Artificial sequence
  Synthetic oligonucleotide
ctggagcactgagatgacct

SEQ ID NO: 767 - DNA, 20 bp, Artificial sequence
  Synthetic oligonucleotide
actggagcactgagatgacc

SEQ ID NO: 768 - DNA, 20 bp, Artificial sequence
  Synthetic oligonucleotide
ggacaggacccactggagca

SEQ ID NO: 769 - DNA, 20 bp, Artificial sequence
  Synthetic oligonucleotide
aggacaggacccactggagc

SEQ ID NO: 770 - DNA, 20 bp, Artificial sequence
  Synthetic oligonucleotide
gaaggacaggacccactgga

SEQ ID NO: 771 - DNA, 20 bp, Artificial sequence
  Synthetic oligonucleotide
ggaaggacaggacccactgg

SEQ ID NO: 772 - DNA, 20 bp, Artificial sequence
  Synthetic oligonucleotide
aaggaaggacaggacccact

SEQ ID NO: 773 - DNA, 20 bp, Artificial sequence
  Synthetic oligonucleotide
caaggaaggacaggacccac

SEQ ID NO: 774 - DNA, 20 bp, Artificial sequence
  Synthetic oligonucleotide
acaaggaaggacaggaccca

SEQ ID NO: 775 - DNA, 20 bp, Artificial sequence
  Synthetic oligonucleotide
gtacaaggaaggacaggacc

SEQ ID NO: 776 - DNA, 20 bp, Artificial sequence
  Synthetic oligonucleotide
agtacaaggaaggacaggac

SEQ ID NO: 777 - DNA, 20 bp, Artificial sequence
  Synthetic oligonucleotide
cagtacaaggaaggacagga

SEQ ID NO: 778 - DNA, 20 bp, Artificial sequence
  Synthetic oligonucleotide
ccagtacaaggaaggacagg

SEQ ID NO: 779 - DNA, 20 bp, Artificial sequence
  Synthetic oligonucleotide
tcccagtacaaggaaggaca

SEQ ID NO: 780 - DNA, 20 bp, Artificial sequence
  Synthetic oligonucleotide
ctcccagtacaaggaaggac

SEQ ID NO: 781 - DNA, 20 bp, Artificial sequence
  Synthetic oligonucleotide
cactcccagtacaaggaagg

SEQ ID NO: 782 - DNA, 20 bp, Artificial sequence
  Synthetic oligonucleotide
ccactcccagtacaaggaag

SEQ ID NO: 783 - DNA, 20 bp, Artificial sequence
  Synthetic oligonucleotide
ggccactcccagtacaagga

SEQ ID NO: 784 - DNA, 20 bp, Artificial sequence
  Synthetic oligonucleotide
aggccactcccagtacaagg

SEQ ID NO: 785 - DNA, 20 bp, Artificial sequence
  Synthetic oligonucleotide
gcaggccactcccagtacaa

SEQ ID NO: 786 - DNA, 20 bp, Artificial sequence
  Synthetic oligonucleotide
tgcaggccactcccagtaca

SEQ ID NO: 787 - DNA, 20 bp, Artificial sequence
  Synthetic oligonucleotide
actgcaggccactcccagta

SEQ ID NO: 788 - DNA, 20 bp, Artificial sequence
  Synthetic oligonucleotide
cactgcaggccactcccagt

SEQ ID NO: 789 - DNA, 20 bp, Artificial sequence
  Synthetic oligonucleotide
ggcactgcaggccactccca

SEQ ID NO: 790 - DNA, 20 bp, Artificial sequence
  Synthetic oligonucleotide
tggcactgcaggccactccc

SEQ ID NO: 791 - DNA, 20 bp, Artificial sequence
  Synthetic oligonucleotide
atggcactgcaggccactcc

SEQ ID NO: 792 - DNA, 20 bp, Artificial sequence
  Synthetic oligonucleotide
ggatggcactgcaggccact

SEQ ID NO: 793 - DNA, 20 bp, Artificial sequence
  Synthetic oligonucleotide
aggatggcactgcaggccac

SEQ ID NO: 794 - DNA, 20 bp, Artificial sequence
  Synthetic oligonucleotide
gaggatggcactgcaggcca

SEQ ID NO: 795 - DNA, 20 bp, Artificial sequence
  Synthetic oligonucleotide
tgaggatggcactgcaggcc

SEQ ID NO: 796 - DNA, 20 bp, Artificial sequence
  Synthetic oligonucleotide
catgaggatggcactgcagg

SEQ ID NO: 797 - DNA, 20 bp, Artificial sequence
  Synthetic oligonucleotide
acatgaggatggcactgcag

SEQ ID NO: 798 - DNA, 20 bp, Artificial sequence
  Synthetic oligonucleotide
tacatgaggatggcactgca

SEQ ID NO: 799 - DNA, 20 bp, Artificial sequence
  Synthetic oligonucleotide
atgtacatgaggatggcact

SEQ ID NO: 800 - DNA, 20 bp, Artificial sequence
  Synthetic oligonucleotide
tatgtacatgaggatggcac

SEQ ID NO: 801 - DNA, 20 bp, Artificial sequence
  Synthetic oligonucleotide
atatgtacatgaggatggca

SEQ ID NO: 802 - DNA, 20 bp, Artificial sequence
  Synthetic oligonucleotide
aatatgtacatgaggatggc

SEQ ID NO: 803 - DNA, 20 bp, Artificial sequence
  Synthetic oligonucleotide
agaatatgtacatgaggatg

SEQ ID NO: 804 - DNA, 20 bp, Artificial sequence
  Synthetic oligonucleotide
cagaatatgtacatgaggat

SEQ ID NO: 805 - DNA, 20 bp, Artificial sequence
  Synthetic oligonucleotide
gcagaatatgtacatgagga

SEQ ID NO: 806 - DNA, 20 bp, Artificial sequence
  Synthetic oligonucleotide
tgcagaatatgtacatgagg

SEQ ID NO: 807 - DNA, 20 bp, Artificial sequence
  Synthetic oligonucleotide
cacagcgatgagccagcaat

SEQ ID NO: 808 - DNA, 20 bp, Artificial sequence
  Synthetic oligonucleotide
gcacagcgatgagccagcaa

SEQ ID NO: 809 - DNA, 20 bp, Artificial sequence
  Synthetic oligonucleotide
gagcacagcgatgagccagc

SEQ ID NO: 810 - DNA, 20 bp, Artificial sequence
  Synthetic oligonucleotide
agagcacagcgatgagccag

SEQ ID NO: 811 - DNA, 20 bp, Artificial sequence
  Synthetic oligonucleotide
gtagagcacagcgatgagcc

SEQ ID NO: 812 - DNA, 20 bp, Artificial sequence
  Synthetic oligonucleotide
agtagagcacagcgatgagc

SEQ ID NO: 813 - DNA, 20 bp, Artificial sequence
  Synthetic oligonucleotide
aagtagagcacagcgatgag

SEQ ID NO: 814 - DNA, 20 bp, Artificial sequence
  Synthetic oligonucleotide
gaagtagagcacagcgatga

SEQ ID NO: 815 - DNA, 20 bp, Artificial sequence
  Synthetic oligonucleotide
gtgaagtagagcacagcgat

SEQ ID NO: 816 - DNA, 20 bp, Artificial sequence
  Synthetic oligonucleotide
agtgaagtagagcacagcga

SEQ ID NO: 817 - DNA, 20 bp, Artificial sequence
  Synthetic oligonucleotide
aagtgaagtagagcacagcg

SEQ ID NO: 818 - DNA, 20 bp, Artificial sequence
  Synthetic oligonucleotide
caagtgaagtagagcacagc

SEQ ID NO: 819 - DNA, 20 bp, Artificial sequence
  Synthetic oligonucleotide
gccaagtgaagtagagcaca

SEQ ID NO: 820 - DNA, 20 bp, Artificial sequence
  Synthetic oligonucleotide
agccaagtgaagtagagcac

SEQ ID NO: 821 - DNA, 20 bp, Artificial sequence
  Synthetic oligonucleotide
ccagccaagtgaagtagagc

SEQ ID NO: 822 - DNA, 20 bp, Artificial sequence
  Synthetic oligonucleotide
accagccaagtgaagtagag

SEQ ID NO: 823 - DNA, 20 bp, Artificial sequence
  Synthetic oligonucleotide
acaccagccaagtgaagtag

SEQ ID NO: 824 - DNA, 20 bp, Artificial sequence
  Synthetic oligonucleotide
aacaccagccaagtgaagta

SEQ ID NO: 825 - DNA, 20 bp, Artificial sequence
  Synthetic oligonucleotide
caaacaccagccaagtgaag

SEQ ID NO: 826 - DNA, 20 bp, Artificial sequence
  Synthetic oligonucleotide
tcaaacaccagccaagtgaa

SEQ ID NO: 827 - DNA, 20 bp, Artificial sequence
  Synthetic oligonucleotide
agtcaaacaccagccaagtg

SEQ ID NO: 828 - DNA, 20 bp, Artificial sequence
  Synthetic oligonucleotide
cagtcaaacaccagccaagt

SEQ ID NO: 829 - DNA, 20 bp, Artificial sequence
  Synthetic oligonucleotide
tccagtcaaacaccagccaa

SEQ ID NO: 830 - DNA, 20 bp, Artificial sequence
  Synthetic oligonucleotide
ttccagtcaaacaccagcca

SEQ ID NO: 831 - DNA, 20 bp, Artificial sequence
  Synthetic oligonucleotide
tgttccagtcaaacaccagc

SEQ ID NO: 832 - DNA, 20 bp, Artificial sequence
  Synthetic oligonucleotide
gtgttccagtcaaacaccag

SEQ ID NO: 833 - DNA, 20 bp, Artificial sequence
  Synthetic oligonucleotide
gtgtgttccagtcaaacacc

SEQ ID NO: 834 - DNA, 20 bp, Artificial sequence
  Synthetic oligonucleotide
ggtgtgttccagtcaaacac

SEQ ID NO: 835 - DNA, 20 bp, Artificial sequence
  Synthetic oligonucleotide
tgggtgtgttccagtcaaac

SEQ ID NO: 836 - DNA, 20 bp, Artificial sequence
  Synthetic oligonucleotide
ttgggtgtgttccagtcaaa

SEQ ID NO: 837 - DNA, 20 bp, Artificial sequence
  Synthetic oligonucleotide
tcttgggtgtgttccagtca

SEQ ID NO: 838 - DNA, 20 bp, Artificial sequence
  Synthetic oligonucleotide
ttcttgggtgtgttccagtc

SEQ ID NO: 839 - DNA, 20 bp, Artificial sequence
  Synthetic oligonucleotide
actgtgacctcctgccacct

SEQ ID NO: 840 - DNA, 20 bp, Artificial sequence
  Synthetic oligonucleotide
cactgtgacctcctgccacc

SEQ ID NO: 841 - DNA, 20 bp, Artificial sequence
  Synthetic oligonucleotide
cccactgtgacctcctgcca

SEQ ID NO: 842 - DNA, 20 bp, Artificial sequence
  Synthetic oligonucleotide
acccactgtgacctcctgcc

SEQ ID NO: 843 - DNA, 20 bp, Artificial sequence
  Synthetic oligonucleotide
ggacccactgtgacctcctg

SEQ ID NO: 844 - DNA, 20 bp, Artificial sequence
  Synthetic oligonucleotide
cggacccactgtgacctcct

SEQ ID NO: 845 - DNA, 20 bp, Artificial sequence
  Synthetic oligonucleotide
tcggacccactgtgacctcc

SEQ ID NO: 846 - DNA, 20 bp, Artificial sequence
  Synthetic oligonucleotide
agcccagtttcggacccact

SEQ ID NO: 847 - DNA, 20 bp, Artificial sequence
  Synthetic oligonucleotide
cagcccagtttcggacccac

SEQ ID NO: 848 - DNA, 20 bp, Artificial sequence
  Synthetic oligonucleotide
cacagcccagtttcggaccc

SEQ ID NO: 849 - DNA, 20 bp, Artificial sequence
  Synthetic oligonucleotide
acacagcccagtttcggacc

SEQ ID NO: 850 - DNA, 20 bp, Artificial sequence
  Synthetic oligonucleotide
ccacacagcccagtttcgga

SEQ ID NO: 851 - DNA, 20 bp, Artificial sequence
  Synthetic oligonucleotide
gccacacagcccagtttcgg

SEQ ID NO: 852 - DNA, 20 bp, Artificial sequence
  Synthetic oligonucleotide
cgccacacagcccagtttcg

SEQ ID NO: 853 - DNA, 20 bp, Artificial sequence
  Synthetic oligonucleotide
aagtagtctcgaaagtagcg

SEQ ID NO: 854 - DNA, 20 bp, Artificial sequence
  Synthetic oligonucleotide
aaagtagtctcgaaagtagc

SEQ ID NO: 855 - DNA, 20 bp, Artificial sequence
  Synthetic oligonucleotide
ggaaagtagtctcgaaagta

SEQ ID NO: 856 - DNA, 20 bp, Artificial sequence
  Synthetic oligonucleotide
gggaaagtagtctcgaaagt

SEQ ID NO: 857 - DNA, 20 bp, Artificial sequence
  Synthetic oligonucleotide
tgggaaagtagtctcgaaag

SEQ ID NO: 858 - DNA, 20 bp, Artificial sequence
  Synthetic oligonucleotide
gatgggaaagtagtctcgaa

SEQ ID NO: 859 - DNA, 20 bp, Artificial sequence
  Synthetic oligonucleotide
ggatgggaaagtagtctcga

SEQ ID NO: 860 - DNA, 20 bp, Artificial sequence
  Synthetic oligonucleotide
ggtggtatccaaagatatag

SEQ ID NO: 861 - DNA, 20 bp, Artificial sequence
  Synthetic oligonucleotide
gggtggtatccaaagatata

SEQ ID NO: 862 - DNA, 20 bp, Artificial sequence
  Synthetic oligonucleotide
ttgcagaaggcacccaggcc

SEQ ID NO: 863 - DNA, 20 bp, Artificial sequence
  Synthetic oligonucleotide
gttgcagaaggcacccaggc

SEQ ID NO: 864 - DNA, 20 bp, Artificial sequence
  Synthetic oligonucleotide
cttctgtggcctctgtgctg

SEQ ID NO: 865 - DNA, 20 bp, Artificial sequence
  Synthetic oligonucleotide
tgtcggaggagaagaggcct

SEQ ID NO: 866 - DNA, 20 bp, Artificial sequence
  Synthetic oligonucleotide
ggtgtcggaggagaagaggc

SEQ ID NO: 867 - DNA, 20 bp, Artificial sequence
  Synthetic oligonucleotide
aggtgtcggaggagaagagg

SEQ ID NO: 868 - DNA, 20 bp, Artificial sequence
  Synthetic oligonucleotide
caggtgtcggaggagaagag

SEQ ID NO: 869 - DNA, 20 bp, Artificial sequence
  Synthetic oligonucleotide
cccaggtgtcggaggagaag

SEQ ID NO: 870 - DNA, 20 bp, Artificial sequence
  Synthetic oligonucleotide
ccccaggtgtcggaggagaa

SEQ ID NO: 871 - DNA, 20 bp, Artificial sequence
  Synthetic oligonucleotide
gcccccaggtgtcggaggag

SEQ ID NO: 872 - DNA, 20 bp, Artificial sequence
  Synthetic oligonucleotide
agcccccaggtgtcggagga

SEQ ID NO: 873 - DNA, 20 bp, Artificial sequence
  Synthetic oligonucleotide
cagcccccaggtgtcggagg

SEQ ID NO: 874 - DNA, 20 bp, Artificial sequence
  Synthetic oligonucleotide
accagcccccaggtgtcgga

SEQ ID NO: 875 - DNA, 20 bp, Artificial sequence
  Synthetic oligonucleotide
aacagtggtgatgggcttgg

SEQ ID NO: 876 - DNA, 20 bp, Artificial sequence
  Synthetic oligonucleotide
caacagtggtgatgggcttg

SEQ ID NO: 877 - DNA, 20 bp, Artificial sequence
  Synthetic oligonucleotide
catggtgtggtacaggtcga

SEQ ID NO: 878 - DNA, 20 bp, Artificial sequence
  Synthetic oligonucleotide
acatggtgtggtacaggtcg

SEQ ID NO: 879 - DNA, 20 bp, Artificial sequence
  Synthetic oligonucleotide
tacatggtgtggtacaggtc

SEQ ID NO: 880 - DNA, 20 bp, Artificial sequence
  Synthetic oligonucleotide
gtacatggtgtggtacaggt

SEQ ID NO: 881 - DNA, 20 bp, Artificial sequence
  Synthetic oligonucleotide
atgtacatggtgtggtacag

SEQ ID NO: 882 - DNA, 20 bp, Artificial sequence
  Synthetic oligonucleotide
catgtacatggtgtggtaca

SEQ ID NO: 883 - DNA, 20 bp, Artificial sequence
  Synthetic oligonucleotide
tccatgtacatggtgtggta

SEQ ID NO: 884 - DNA, 20 bp, Artificial sequence
  Synthetic oligonucleotide
ctccatgtacatggtgtggt

SEQ ID NO: 885 - DNA, 20 bp, Artificial sequence
  Synthetic oligonucleotide
cctccatgtacatggtgtgg

SEQ ID NO: 886 - DNA, 20 bp, Artificial sequence
  Synthetic oligonucleotide
ggcctccatgtacatggtgt

SEQ ID NO: 887 - DNA, 20 bp, Artificial sequence
  Synthetic oligonucleotide
gggcctccatgtacatggtg

SEQ ID NO: 888 - DNA, 20 bp, Artificial sequence
  Synthetic oligonucleotide
agggcctccatgtacatggt

SEQ ID NO: 889 - DNA, 20 bp, Artificial sequence
  Synthetic oligonucleotide
tcgaagagcttcaccagggc

SEQ ID NO: 890 - DNA, 20 bp, Artificial sequence
  Synthetic oligonucleotide
gtcgaagagcttcaccaggg

SEQ ID NO: 891 - DNA, 20 bp, Artificial sequence
  Synthetic oligonucleotide
ttgtcgaagagcttcaccag

SEQ ID NO: 892 - DNA, 20 bp, Artificial sequence
  Synthetic oligonucleotide
cttgtcgaagagcttcacca

SEQ ID NO: 893 - DNA, 20 bp, Artificial sequence
  Synthetic oligonucleotide
gcttgtcgaagagcttcacc

SEQ ID NO: 894 - DNA, 20 bp, Artificial sequence
  Synthetic oligonucleotide
tgcttgtcgaagagcttcac

SEQ ID NO: 895 - DNA, 20 bp, Artificial sequence
  Synthetic oligonucleotide
tgtgcttgtcgaagagcttc

SEQ ID NO: 896 - DNA, 20 bp, Artificial sequence
  Synthetic oligonucleotide
ttgtgcttgtcgaagagctt

SEQ ID NO: 897 - DNA, 20 bp, Artificial sequence
  Synthetic oligonucleotide
cttgtgcttgtcgaagagct

SEQ ID NO: 898 - DNA, 20 bp, Artificial sequence
  Synthetic oligonucleotide
cttggtcttgtgcttgtcga

SEQ ID NO: 899 - DNA, 20 bp, Artificial sequence
  Synthetic oligonucleotide
acttggtcttgtgcttgtcg

SEQ ID NO: 900 - DNA, 20 bp, Artificial sequence
  Synthetic oligonucleotide
aacttggtcttgtgcttgtc

SEQ ID NO: 901 - DNA, 20 bp, Artificial sequence
  Synthetic oligonucleotide
cgaacttggtcttgtgcttg

SEQ ID NO: 902 - DNA, 20 bp, Artificial sequence
  Synthetic oligonucleotide
ccgaacttggtcttgtgctt

SEQ ID NO: 903 - DNA, 20 bp, Artificial sequence
  Synthetic oligonucleotide
gccgaacttggtcttgtgct

SEQ ID NO: 904 - DNA, 20 bp, Artificial sequence
  Synthetic oligonucleotide
ggccgaacttggtcttgtgc

SEQ ID NO: 905 - DNA, 20 bp, Artificial sequence
  Synthetic oligonucleotide
gaggccgaacttggtcttgt

SEQ ID NO: 906 - DNA, 20 bp, Artificial sequence
  Synthetic oligonucleotide
ggaggccgaacttggtcttg

SEQ ID NO: 907 - DNA, 20 bp, Artificial sequence
  Synthetic oligonucleotide
acctccaggacctcagtctc

SEQ ID NO: 908 - DNA, 20 bp, Artificial sequence
  Synthetic oligonucleotide
cacctccaggacctcagtct

SEQ ID NO: 909 - DNA, 20 bp, Artificial sequence
  Synthetic oligonucleotide
tcacctccaggacctcagtc

SEQ ID NO: 910 - DNA, 20 bp, Artificial sequence
  Synthetic oligonucleotide
gttcacctccaggacctcag

SEQ ID NO: 911 - DNA, 20 bp, Artificial sequence
  Synthetic oligonucleotide
agttcacctccaggacctca

SEQ ID NO: 912 - DNA, 20 bp, Artificial sequence
  Synthetic oligonucleotide
cagttcacctccaggacctc

SEQ ID NO: 913 - DNA, 20 bp, Artificial sequence
  Synthetic oligonucleotide
ctcagttcacctccaggacc

SEQ ID NO: 914 - DNA, 20 bp, Artificial sequence
  Synthetic oligonucleotide
gctcagttcacctccaggac

SEQ ID NO: 915 - DNA, 20 bp, Artificial sequence
  Synthetic oligonucleotide
ggctcagttcacctccagga

SEQ ID NO: 916 - DNA, 20 bp, Artificial sequence
  Synthetic oligonucleotide
tggctcagttcacctccagg

SEQ ID NO: 917 - DNA, 20 bp, Artificial sequence
  Synthetic oligonucleotide
ttgtaatggtttagcaaaat

SEQ ID NO: 918 - DNA, 20 bp, Artificial sequence
  Synthetic oligonucleotide
attgtaatggtttagcaaaa

SEQ ID NO: 919 - DNA, 20 bp, Artificial sequence
  Synthetic oligonucleotide
cattgtaatggtttagcaaa

SEQ ID NO: 920 - DNA, 20 bp, Artificial sequence
  Synthetic oligonucleotide
acattgtaatggtttagcaa

SEQ ID NO: 921 - DNA, 20 bp, Artificial sequence
  Synthetic oligonucleotide
taacattgtaatggtttagc

SEQ ID NO: 922 - DNA, 20 bp, Artificial sequence
  Synthetic oligonucleotide
ctaacattgtaatggtttag

SEQ ID NO: 923 - DNA, 20 bp, Artificial sequence
  Synthetic oligonucleotide
cctaacattgtaatggttta

SEQ ID NO: 924 - DNA, 20 bp, Artificial sequence
  Synthetic oligonucleotide
acctaacattgtaatggttt

SEQ ID NO: 925 - DNA, 20 bp, Artificial sequence
  Synthetic oligonucleotide
agacctaacattgtaatggt

SEQ ID NO: 926 - DNA, 20 bp, Artificial sequence
  Synthetic oligonucleotide
aagacctaacattgtaatgg

SEQ ID NO: 927 - DNA, 20 bp, Artificial sequence
  Synthetic oligonucleotide
aaagacctaacattgtaatg

SEQ ID NO: 928 - DNA, 20 bp, Artificial sequence
  Synthetic oligonucleotide
aaaagacctaacattgtaat

SEQ ID NO: 929 - DNA, 20 bp, Artificial sequence
  Synthetic oligonucleotide
aaaaaagacctaacattgta

SEQ ID NO: 930 - DNA, 20 bp, Artificial sequence
  Synthetic oligonucleotide
taaaaaagacctaacattgt

SEQ ID NO: 931 - DNA, 20 bp, Artificial sequence
  Synthetic oligonucleotide
cttaaaaaagacctaacatt

SEQ ID NO: 932 - DNA, 20 bp, Artificial sequence
  Synthetic oligonucleotide
tcttaaaaaagacctaacat

SEQ ID NO: 933 - DNA, 20 bp, Artificial sequence
  Synthetic oligonucleotide
ctccaactcctccccttggc

SEQ ID NO: 934 - DNA, 20 bp, Artificial sequence
  Synthetic oligonucleotide
tctccaactcctccccttgg

SEQ ID NO: 935 - DNA, 20 bp, Artificial sequence
  Synthetic oligonucleotide
gctctccaactcctcccctt

SEQ ID NO: 936 - DNA, 20 bp, Artificial sequence
  Synthetic oligonucleotide
tgctctccaactcctcccct

SEQ ID NO: 937 - DNA, 20 bp, Artificial sequence
  Synthetic oligonucleotide
cattccagatgcctactact

SEQ ID NO: 938 - DNA, 20 bp, Artificial sequence
  Synthetic oligonucleotide
gcattccagatgcctactac

SEQ ID NO: 939 - DNA, 20 bp, Artificial sequence
  Synthetic oligonucleotide
agcattccagatgcctacta

SEQ ID NO: 940 - DNA, 20 bp, Artificial sequence
  Synthetic oligonucleotide
gagcattccagatgcctact

SEQ ID NO: 941 - DNA, 20 bp, Artificial sequence
  Synthetic oligonucleotide
cctggaggccagtccaggct

SEQ ID NO: 942 - DNA, 20 bp, Artificial sequence
  Synthetic oligonucleotide
tcctggaggccagtccaggc

SEQ ID NO: 943 - DNA, 20 bp, Artificial sequence
  Synthetic oligonucleotide
catcctggaggccagtccag

SEQ ID NO: 944 - DNA, 20 bp, Artificial sequence
  Synthetic oligonucleotide
tcatcctggaggccagtcca

SEQ ID NO: 945 - DNA, 20 bp, Artificial sequence
  Synthetic oligonucleotide
cctcatcctggaggccagtc

SEQ ID NO: 946 - DNA, 20 bp, Artificial sequence
  Synthetic oligonucleotide
tcctcatcctggaggccagt

SEQ ID NO: 947 - DNA, 20 bp, Artificial sequence
  Synthetic oligonucleotide
atcctcatcctggaggccag

SEQ ID NO: 948 - DNA, 20 bp, Artificial sequence
  Synthetic oligonucleotide
catcctcatcctggaggcca

SEQ ID NO: 949 - DNA, 20 bp, Artificial sequence
  Synthetic oligonucleotide
cccatcctcatcctggaggc

SEQ ID NO: 950 - DNA, 20 bp, Artificial sequence
  Synthetic oligonucleotide
ccccatcctcatcctggagg

SEQ ID NO: 951 - DNA, 20 bp, Artificial sequence
  Synthetic oligonucleotide
acccccatcctcatcctgga

SEQ ID NO: 952 - DNA, 20 bp, Artificial sequence
  Synthetic oligonucleotide
cacccccatcctcatcctgg

SEQ ID NO: 953 - DNA, 20 bp, Artificial sequence
  Synthetic oligonucleotide
ccacccccatcctcatcctg

SEQ ID NO: 954 - DNA, 20 bp, Artificial sequence
  Synthetic oligonucleotide
tgccacccccatcctcatcc

SEQ ID NO: 955 - DNA, 20 bp, Artificial sequence
  Synthetic oligonucleotide
ttgccacccccatcctcatc

SEQ ID NO: 956 - DNA, 20 bp, Artificial sequence
  Synthetic oligonucleotide
attgccacccccatcctcat

SEQ ID NO: 957 - DNA, 20 bp, Artificial sequence
  Synthetic oligonucleotide
tcattgccacccccatcctc

SEQ ID NO: 958 - DNA, 20 bp, Artificial sequence
  Synthetic oligonucleotide
gtcattgccacccccatcct

SEQ ID NO: 959 - DNA, 20 bp, Artificial sequence
  Synthetic oligonucleotide
tgtcattgccacccccatcc

SEQ ID NO: 960 - DNA, 20 bp, Artificial sequence
  Synthetic oligonucleotide
ggtgtcattgccacccccat

SEQ ID NO: 961 - DNA, 20 bp, Artificial sequence
  Synthetic oligonucleotide
gctcatggtggcggcatcct

SEQ ID NO: 962 - DNA, 20 bp, Artificial sequence
  Synthetic oligonucleotide
agctcatggtggcggcatcc

SEQ ID NO: 963 - DNA, 20 bp, Artificial sequence
  Synthetic oligonucleotide
ctagctcatggtggcggcat

SEQ ID NO: 964 - DNA, 20 bp, Artificial sequence
  Synthetic oligonucleotide
cctagctcatggtggcggca

SEQ ID NO: 965 - DNA, 20 bp, Artificial sequence
  Synthetic oligonucleotide
cacctagctcatggtggcgg

SEQ ID NO: 966 - DNA, 20 bp, Artificial sequence
  Synthetic oligonucleotide
ccacctagctcatggtggcg

SEQ ID NO: 967 - DNA, 20 bp, Artificial sequence
  Synthetic oligonucleotide
ctccacctagctcatggtgg

SEQ ID NO: 968 - DNA, 20 bp, Artificial sequence
  Synthetic oligonucleotide
actccacctagctcatggtg

SEQ ID NO: 969 - DNA, 20 bp, Artificial sequence
  Synthetic oligonucleotide
tactccacctagctcatggt

SEQ ID NO: 970 - DNA, 20 bp, Artificial sequence
  Synthetic oligonucleotide
gttactccacctagctcatg

SEQ ID NO: 971 - DNA, 20 bp, Artificial sequence
  Synthetic oligonucleotide
agttactccacctagctcat

SEQ ID NO: 972 - DNA, 20 bp, Artificial sequence
  Synthetic oligonucleotide
cagttactccacctagctca

SEQ ID NO: 973 - DNA, 20 bp, Artificial sequence
  Synthetic oligonucleotide
ccagttactccacctagctc

SEQ ID NO: 974 - DNA, 20 bp, Artificial sequence
  Synthetic oligonucleotide
aaccagttactccacctagc

SEQ ID NO: 975 - DNA, 20 bp, Artificial sequence
  Synthetic oligonucleotide
aaaccagttactccacctag

SEQ ID NO: 976 - DNA, 20 bp, Artificial sequence
  Synthetic oligonucleotide
aaaaaccagttactccacct

SEQ ID NO: 977 - DNA, 20 bp, Artificial sequence
  Synthetic oligonucleotide
gaaaaaccagttactccacc

SEQ ID NO: 978 - DNA, 20 bp, Artificial sequence
  Synthetic oligonucleotide
aagaaaaaccagttactcca

SEQ ID NO: 979 - DNA, 20 bp, Artificial sequence
  Synthetic oligonucleotide
caagaaaaaccagttactcc

SEQ ID NO: 980 - DNA, 20 bp, Artificial sequence
  Synthetic oligonucleotide
cccaagaaaaaccagttact

SEQ ID NO: 981 - DNA, 20 bp, Artificial sequence
  Synthetic oligonucleotide
acccaagaaaaaccagttac

SEQ ID NO: 982 - DNA, 20 bp, Artificial sequence
  Synthetic oligonucleotide
cacccaagaaaaaccagtta

SEQ ID NO: 983 - DNA, 20 bp, Artificial sequence
  Synthetic oligonucleotide
ccacccaagaaaaaccagtt

SEQ ID NO: 984 - DNA, 20 bp, Artificial sequence
  Synthetic oligonucleotide
agccacccaagaaaaaccag

SEQ ID NO: 985 - DNA, 20 bp, Artificial sequence
  Synthetic oligonucleotide
cagccacccaagaaaaacca

SEQ ID NO: 986 - DNA, 20 bp, Artificial sequence
  Synthetic oligonucleotide
atcagccacccaagaaaaac

SEQ ID NO: 987 - DNA, 20 bp, Artificial sequence
  Synthetic oligonucleotide
catcagccacccaagaaaaa

SEQ ID NO: 988 - DNA, 20 bp, Artificial sequence
  Synthetic oligonucleotide
tcatcagccacccaagaaaa

SEQ ID NO: 989 - DNA, 20 bp, Artificial sequence
  Synthetic oligonucleotide
tgtcatcagccacccaagaa

SEQ ID NO: 990 - DNA, 20 bp, Artificial sequence
  Synthetic oligonucleotide
atgtcatcagccacccaaga

SEQ ID NO: 991 - DNA, 20 bp, Artificial sequence
  Synthetic oligonucleotide
ccatgtcatcagccacccaa

SEQ ID NO: 992 - DNA, 20 bp, Artificial sequence
  Synthetic oligonucleotide
tccatgtcatcagccaccca

SEQ ID NO: 993 - DNA, 20 bp, Artificial sequence
  Synthetic oligonucleotide
atccatgtcatcagccaccc

SEQ ID NO: 994 - DNA, 20 bp, Artificial sequence
  Synthetic oligonucleotide
catccatgtcatcagccacc

SEQ ID NO: 995 - DNA, 20 bp, Artificial sequence
  Synthetic oligonucleotide
tgcatccatgtcatcagcca

SEQ ID NO: 996 - DNA, 20 bp, Artificial sequence
  Synthetic oligonucleotide
ctgcatccatgtcatcagcc

SEQ ID NO: 997 - DNA, 20 bp, Artificial sequence
  Synthetic oligonucleotide
tgctgcatccatgtcatcag

SEQ ID NO: 998 - DNA, 20 bp, Artificial sequence
  Synthetic oligonucleotide
gtgctgcatccatgtcatca

SEQ ID NO: 999 - DNA, 20 bp, Artificial sequence
  Synthetic oligonucleotide
ctgtgctgcatccatgtcat

SEQ ID NO: 1000 - DNA, 20 bp, Artificial sequence
  Synthetic oligonucleotide
tctgtgctgcatccatgtca

SEQ ID NO: 1001 - DNA, 20 bp, Artificial sequence
  Synthetic oligonucleotide
gtctgtgctgcatccatgtc

SEQ ID NO: 1002 - DNA, 20 bp, Artificial sequence
  Synthetic oligonucleotide
agtctgtgctgcatccatgt

SEQ ID NO: 1003 - DNA, 20 bp, Artificial sequence
  Synthetic oligonucleotide
tgagtctgtgctgcatccat

SEQ ID NO: 1004 - DNA, 20 bp, Artificial sequence
  Synthetic oligonucleotide
ctgagtctgtgctgcatcca

SEQ ID NO: 1005 - DNA, 20 bp, Artificial sequence
  Synthetic oligonucleotide
gctgagtctgtgctgcatcc

SEQ ID NO: 1006 - DNA, 20 bp, Artificial sequence
  Synthetic oligonucleotide
ggctgagtctgtgctgcatc

SEQ ID NO: 1007 - DNA, 20 bp, Artificial sequence
  Synthetic oligonucleotide
aggctgagtctgtgctgcat

SEQ ID NO: 1008 - DNA, 20 bp, Artificial sequence
  Synthetic oligonucleotide
aaggctgagtctgtgctgca

SEQ ID NO: 1009 - DNA, 20 bp, Artificial sequence
  Synthetic oligonucleotide
ccaaggctgagtctgtgctg

SEQ ID NO: 1010 - DNA, 20 bp, Artificial sequence
  Synthetic oligonucleotide
gccaaggctgagtctgtgct

SEQ ID NO: 1011 - DNA, 20 bp, Artificial sequence
  Synthetic oligonucleotide
aggccaaggctgagtctgtg

SEQ ID NO: 1012 - DNA, 20 bp, Artificial sequence
  Synthetic oligonucleotide
caggccaaggctgagtctgt

SEQ ID NO: 1013 - DNA, 20 bp, Artificial sequence
  Synthetic oligonucleotide
tccaggccaaggctgagtct

SEQ ID NO: 1014 - DNA, 20 bp, Artificial sequence
  Synthetic oligonucleotide
ctccaggccaaggctgagtc

SEQ ID NO: 1015 - DNA, 20 bp, Artificial sequence
  Synthetic oligonucleotide
gctccaggccaaggctgagt

SEQ ID NO: 1016 - DNA, 20 bp, Artificial sequence
  Synthetic oligonucleotide
tgctccaggccaaggctgag

SEQ ID NO: 1017 - DNA, 20 bp, Artificial sequence
  Synthetic oligonucleotide
tgtgctccaggccaaggctg

SEQ ID NO: 1018 - DNA, 20 bp, Artificial sequence
  Synthetic oligonucleotide
atgtgctccaggccaaggct

SEQ ID NO: 1019 - DNA, 20 bp, Artificial sequence
  Synthetic oligonucleotide
aggtaaactgaggccaccag

SEQ ID NO: 1020 - DNA, 20 bp, Artificial sequence
  Synthetic oligonucleotide
gaaggtaaactgaggccacc

SEQ ID NO: 1021 - DNA, 20 bp, Artificial sequence
  Synthetic oligonucleotide
ggaaggtaaactgaggccac

SEQ ID NO: 1022 - DNA, 20 bp, Artificial sequence
  Synthetic oligonucleotide
tcttcctcacatccagaatc

SEQ ID NO: 1023 - DNA, 20 bp, Artificial sequence
  Synthetic oligonucleotide
ctcttcctcacatccagaat

SEQ ID NO: 1024 - DNA, 20 bp, Artificial sequence
  Synthetic oligonucleotide
caggccccttctgaagaggg

SEQ ID NO: 1025 - DNA, 20 bp, Artificial sequence
  Synthetic oligonucleotide
ccaggccccttctgaagagg

SEQ ID NO: 1026 - DNA, 20 bp, Artificial sequence
  Synthetic oligonucleotide
ggccaggccccttctgaaga

SEQ ID NO: 1027 - DNA, 20 bp, Artificial sequence
  Synthetic oligonucleotide
aggccaggccccttctgaag

SEQ ID NO: 1028 - DNA, 20 bp, Artificial sequence
  Synthetic oligonucleotide
gaaggccaggccccttctga

SEQ ID NO: 1029 - DNA, 20 bp, Artificial sequence
  Synthetic oligonucleotide
agaaggccaggccccttctg

SEQ ID NO: 1030 - DNA, 20 bp, Artificial sequence
  Synthetic oligonucleotide
cagaaggccaggccccttct

SEQ ID NO: 1031 - DNA, 20 bp, Artificial sequence
  Synthetic oligonucleotide
ctcagaaggccaggcccctt

SEQ ID NO: 1032 - DNA, 20 bp, Artificial sequence
  Synthetic oligonucleotide
gctcagaaggccaggcccct

SEQ ID NO: 1033 - DNA, 20 bp, Artificial sequence
  Synthetic oligonucleotide
ctgctcagaaggccaggccc

SEQ ID NO: 1034 - DNA, 20 bp, Artificial sequence
  Synthetic oligonucleotide
gctgctcagaaggccaggcc

SEQ ID NO: 1035 - DNA, 20 bp, Artificial sequence
  Synthetic oligonucleotide
ctgctgctcagaaggccagg

SEQ ID NO: 1036 - DNA, 20 bp, Artificial sequence
  Synthetic oligonucleotide
tctgctgctcagaaggccag

SEQ ID NO: 1037 - DNA, 20 bp, Artificial sequence
  Synthetic oligonucleotide
atctgctgctcagaaggcca

SEQ ID NO: 1038 - DNA, 20 bp, Artificial sequence
  Synthetic oligonucleotide
aatctgctgctcagaaggcc

SEQ ID NO: 1039 - DNA, 20 bp, Artificial sequence
  Synthetic oligonucleotide
ctaatctgctgctcagaagg

SEQ ID NO: 1040 - DNA, 20 bp, Artificial sequence
  Synthetic oligonucleotide
actaatctgctgctcagaag

SEQ ID NO: 1041 - DNA, 20 bp, Artificial sequence
  Synthetic oligonucleotide
aactaatctgctgctcagaa

SEQ ID NO: 1042 - DNA, 20 bp, Artificial sequence
  Synthetic oligonucleotide
gaactaatctgctgctcaga

SEQ ID NO: 1043 - DNA, 20 bp, Artificial sequence
  Synthetic oligonucleotide
ggaactaatctgctgctcag

SEQ ID NO: 1044 - DNA, 20 bp, Artificial sequence
  Synthetic oligonucleotide
tggaactaatctgctgctca

SEQ ID NO: 1045 - DNA, 20 bp, Artificial sequence
  Synthetic oligonucleotide
ttggaactaatctgctgctc

SEQ ID NO: 1046 - DNA, 20 bp, Artificial sequence
  Synthetic oligonucleotide
ctttggaactaatctgctgc

SEQ ID NO: 1047 - DNA, 20 bp, Artificial sequence
  Synthetic oligonucleotide
gctttggaactaatctgctg

SEQ ID NO: 1048 - DNA, 20 bp, Artificial sequence
  Synthetic oligonucleotide
tgctttggaactaatctgct

SEQ ID NO: 1049 - DNA, 20 bp, Artificial sequence
  Synthetic oligonucleotide
ctgctttggaactaatctgc

SEQ ID NO: 1050 - DNA, 20 bp, Artificial sequence
  Synthetic oligonucleotide
cctgctttggaactaatctg

SEQ ID NO: 1051 - DNA, 20 bp, Artificial sequence
  Synthetic oligonucleotide
cacctgctttggaactaatc

SEQ ID NO: 1052 - DNA, 20 bp, Artificial sequence
  Synthetic oligonucleotide
ccacctgctttggaactaat

SEQ ID NO: 1053 - DNA, 20 bp, Artificial sequence
  Synthetic oligonucleotide
ggccacctgctttggaacta

SEQ ID NO: 1054 - DNA, 20 bp, Artificial sequence
  Synthetic oligonucleotide
gggccacctgctttggaact

SEQ ID NO: 1055 - DNA, 20 bp, Artificial sequence
  Synthetic oligonucleotide
aaagtgaggcttgggttcgg

SEQ ID NO: 1056 - DNA, 20 bp, Artificial sequence
  Synthetic oligonucleotide
aaaagtgaggcttgggttcg

SEQ ID NO: 1057 - DNA, 20 bp, Artificial sequence
  Synthetic oligonucleotide
agaaaagtgaggcttgggtt

SEQ ID NO: 1058 - DNA, 20 bp, Artificial sequence
  Synthetic oligonucleotide
cagaaaagtgaggcttgggt

SEQ ID NO: 1059 - DNA, 20 bp, Artificial sequence
  Synthetic oligonucleotide
cacagaaaagtgaggcttgg

SEQ ID NO: 1060 - DNA, 20 bp, Artificial sequence
  Synthetic oligonucleotide
gcacagaaaagtgaggcttg

SEQ ID NO: 1061 - DNA, 20 bp, Artificial sequence
  Synthetic oligonucleotide
aggcacagaaaagtgaggct

SEQ ID NO: 1062 - DNA, 20 bp, Artificial sequence
  Synthetic oligonucleotide
aaggcacagaaaagtgaggc

SEQ ID NO: 1063 - DNA, 20 bp, Artificial sequence
  Synthetic oligonucleotide
ggaaggcacagaaaagtgag

SEQ ID NO: 1064 - DNA, 20 bp, Artificial sequence
  Synthetic oligonucleotide
aggaaggcacagaaaagtga

SEQ ID NO: 1065 - DNA, 20 bp, Artificial sequence
  Synthetic oligonucleotide
tcaggaaggcacagaaaagt

SEQ ID NO: 1066 - DNA, 20 bp, Artificial sequence
  Synthetic oligonucleotide
ctcaggaaggcacagaaaag

SEQ ID NO: 1067 - DNA, 20 bp, Artificial sequence
  Synthetic oligonucleotide
ccctcaggaaggcacagaaa

SEQ ID NO: 1068 - DNA, 20 bp, Artificial sequence
  Synthetic oligonucleotide
cccctcaggaaggcacagaa

SEQ ID NO: 1069 - DNA, 20 bp, Artificial sequence
  Synthetic oligonucleotide
ccccctcaggaaggcacaga

SEQ ID NO: 1070 - DNA, 20 bp, Artificial sequence
  Synthetic oligonucleotide
aaccccctcaggaaggcaca

SEQ ID NO: 1071 - DNA, 20 bp, Artificial sequence
  Synthetic oligonucleotide
caaccccctcaggaaggcac

SEQ ID NO: 1072 - DNA, 20 bp, Artificial sequence
  Synthetic oligonucleotide
ccaaccccctcaggaaggca

SEQ ID NO: 1073 - DNA, 20 bp, Artificial sequence
  Synthetic oligonucleotide
cccaaccccctcaggaaggc

SEQ ID NO: 1074 - DNA, 20 bp, Artificial sequence
  Synthetic oligonucleotide
gcccaaccccctcaggaagg

SEQ ID NO: 1075 - DNA, 20 bp, Artificial sequence
  Synthetic oligonucleotide
ctcatcaagagataacagaa

SEQ ID NO: 1076 - DNA, 20 bp, Artificial sequence
  Synthetic oligonucleotide
atctcatcaagagataacag

SEQ ID NO: 1077 - DNA, 20 bp, Artificial sequence
  Synthetic oligonucleotide
gatctcatcaagagataaca

SEQ ID NO: 1078 - DNA, 20 bp, Artificial sequence
  Synthetic oligonucleotide
atgatctcatcaagagataa

SEQ ID NO: 1079 - DNA, 20 bp, Artificial sequence
  Synthetic oligonucleotide
acaaaagtctgacatggtgc

SEQ ID NO: 1080 - DNA, 20 bp, Artificial sequence
  Synthetic oligonucleotide
atacaaaagtctgacatggt

SEQ ID NO: 1081 - DNA, 20 bp, Artificial sequence
  Synthetic oligonucleotide
tatacaaaagtctgacatgg

SEQ ID NO: 1082 - DNA, 20 bp, Artificial sequence
  Synthetic oligonucleotide
catatacaaaagtctgacat

SEQ ID NO: 1083 - DNA, 20 bp, Artificial sequence
  Synthetic oligonucleotide
gcatatacaaaagtctgaca

SEQ ID NO: 1084 - DNA, 20 bp, Artificial sequence
  Synthetic oligonucleotide
ggcatatacaaaagtctgac

SEQ ID NO: 1085 - DNA, 17 bp, Artificial sequence
  Synthetic oligonucleotide
cagggccctttccagaa

SEQ ID NO: 1086 - DNA, 17 bp, Artificial sequence
  Synthetic oligonucleotide
acagggccctttccaga

SEQ ID NO: 1087 - DNA, 17 bp, Artificial sequence
  Synthetic oligonucleotide
cacagggccctttccag

SEQ ID NO: 1088 - DNA, 17 bp, Artificial sequence
  Synthetic oligonucleotide
cgaatatccctaataac

SEQ ID NO: 1089 - DNA, 17 bp, Artificial sequence
  Synthetic oligonucleotide
tcgaatatccctaataa

SEQ ID NO: 1090 - DNA, 17 bp, Artificial sequence
  Synthetic oligonucleotide
ctcgaatatccctaata

SEQ ID NO: 1091 - DNA, 17 bp, Artificial sequence
  Synthetic oligonucleotide
gacccactggagcactg

SEQ ID NO: 1092 - DNA, 17 bp, Artificial sequence
  Synthetic oligonucleotide
ggacccactggagcact

SEQ ID NO: 1093 - DNA, 17 bp, Artificial sequence
  Synthetic oligonucleotide
aggacccactggagcac

SEQ ID NO: 1094 - DNA, 17 bp, Artificial sequence
  Synthetic oligonucleotide
cagcgatgagccagcaa

SEQ ID NO: 1095 - DNA, 17 bp, Artificial sequence
  Synthetic oligonucleotide
acagcgatgagccagca

SEQ ID NO: 1096 - DNA, 17 bp, Artificial sequence
  Synthetic oligonucleotide
cacagcgatgagccagc

SEQ ID NO: 1097 - DNA, 17 bp, Artificial sequence
  Synthetic oligonucleotide
gcacagcgatgagccag

SEQ ID NO: 1098 - DNA, 17 bp, Artificial sequence
  Synthetic oligonucleotide
agcacagcgatgagcca

SEQ ID NO: 1099 - DNA, 17 bp, Artificial sequence
  Synthetic oligonucleotide
gagcacagcgatgagcc

SEQ ID NO: 1100 - DNA, 17 bp, Artificial sequence
  Synthetic oligonucleotide
ttcttgccaggcatgga

SEQ ID NO: 1101 - DNA, 17 bp, Artificial sequence
  Synthetic oligonucleotide
attcttgccaggcatgg

SEQ ID NO: 1102 - DNA, 17 bp, Artificial sequence
  Synthetic oligonucleotide
cattcttgccaggcatg

SEQ ID NO: 1103 - DNA, 17 bp, Artificial sequence
  Synthetic oligonucleotide
ctgcattcttgccaggc

SEQ ID NO: 1104 - DNA, 17 bp, Artificial sequence
  Synthetic oligonucleotide
actgcattcttgccagg

SEQ ID NO: 1105 - DNA, 17 bp, Artificial sequence
  Synthetic oligonucleotide
gactgcattcttgccag

SEQ ID NO: 1106 - DNA, 17 bp, Artificial sequence
  Synthetic oligonucleotide
tccgcagggtgactgca

SEQ ID NO: 1107 - DNA, 17 bp, Artificial sequence
  Synthetic oligonucleotide
ttccgcagggtgactgc

SEQ ID NO: 1108 - DNA, 17 bp, Artificial sequence
  Synthetic oligonucleotide
gttccgcagggtgactg

SEQ ID NO: 1109 - DNA, 17 bp, Artificial sequence
  Synthetic oligonucleotide
acacttcattctctcca

SEQ ID NO: 1110 - DNA, 17 bp, Artificial sequence
  Synthetic oligonucleotide
tacacttcattctctcc

SEQ ID NO: 1111 - DNA, 17 bp, Artificial sequence
  Synthetic oligonucleotide
gtacacttcattctctc

SEQ ID NO: 1112 - DNA, 17 bp, Artificial sequence
  Synthetic oligonucleotide
tgtacacttcattctct

SEQ ID NO: 1113 - DNA, 17 bp, Artificial sequence
  Synthetic oligonucleotide
ttgtacacttcattctc

SEQ ID NO: 1114 - DNA, 17 bp, Artificial sequence
  Synthetic oligonucleotide
cttgtacacttcattct

SEQ ID NO: 1115 - DNA, 17 bp, Artificial sequence
  Synthetic oligonucleotide
gcttgtacacttcattc

SEQ ID NO: 1116 - DNA, 17 bp, Artificial sequence
  Synthetic oligonucleotide
tgcttgtacacttcatt

SEQ ID NO: 1117 - DNA, 17 bp, Artificial sequence
  Synthetic oligonucleotide
ctgcttgtacacttcat

SEQ ID NO: 1118 - DNA, 17 bp, Artificial sequence
  Synthetic oligonucleotide
cctgcttgtacacttca

SEQ ID NO: 1119 - DNA, 17 bp, Artificial sequence
  Synthetic oligonucleotide
acctgcttgtacacttc

SEQ ID NO: 1120 - DNA, 17 bp, Artificial sequence
  Synthetic oligonucleotide
cacctgcttgtacactt

SEQ ID NO: 1121 - DNA, 17 bp, Artificial sequence
  Synthetic oligonucleotide
tcacctgcttgtacact

SEQ ID NO: 1122 - DNA, 17 bp, Artificial sequence
  Synthetic oligonucleotide
atcacctgcttgtacac

SEQ ID NO: 1123 - DNA, 17 bp, Artificial sequence
  Synthetic oligonucleotide
ctcctcgaagatcacct

SEQ ID NO: 1124 - DNA, 17 bp, Artificial sequence
  Synthetic oligonucleotide
cctcctcgaagatcacc

SEQ ID NO: 1125 - DNA, 17 bp, Artificial sequence
  Synthetic oligonucleotide
ccctcctcgaagatcac

SEQ ID NO: 1126 - DNA, 17 bp, Artificial sequence
  Synthetic oligonucleotide
tgtcgaagagcttcacc

SEQ ID NO: 1127 - DNA, 17 bp, Artificial sequence
  Synthetic oligonucleotide
ttgtcgaagagcttcac

SEQ ID NO: 1128 - DNA, 17 bp, Artificial sequence
  Synthetic oligonucleotide
cttgtcgaagagcttca

SEQ ID NO: 1129 - DNA, 17 bp, Artificial sequence
  Synthetic oligonucleotide
gtgcttgtcgaagagct

SEQ ID NO: 1130 - DNA, 17 bp, Artificial sequence
  Synthetic oligonucleotide
tgtgcttgtcgaagagc

SEQ ID NO: 1131 - DNA, 17 bp, Artificial sequence
  Synthetic oligonucleotide
ttgtgcttgtcgaagag

SEQ ID NO: 1132 - DNA, 17 bp, Artificial sequence
  Synthetic oligonucleotide
tcagttcacctccagga

SEQ ID NO: 1133 - DNA, 17 bp, Artificial sequence
  Synthetic oligonucleotide
ctcagttcacctccagg

SEQ ID NO: 1134 - DNA, 17 bp, Artificial sequence
  Synthetic oligonucleotide
gctcagttcacctccag

SEQ ID NO: 1135 - DNA, 17 bp, Artificial sequence
  Synthetic oligonucleotide
ggctcagttcacctcca

SEQ ID NO: 1136 - DNA, 17 bp, Artificial sequence
  Synthetic oligonucleotide
taacccacagacaccca

SEQ ID NO: 1137 - DNA, 17 bp, Artificial sequence
  Synthetic oligonucleotide
ataacccacagacaccc

SEQ ID NO: 1138 - DNA, 17 bp, Artificial sequence
  Synthetic oligonucleotide
aataacccacagacacc

SEQ ID NO: 1139 - DNA, 17 bp, Artificial sequence
  Synthetic oligonucleotide
agatttagccaccacct

SEQ ID NO: 1140 - DNA, 17 bp, Artificial sequence
  Synthetic oligonucleotide
cagatttagccaccacc

SEQ ID NO: 1141 - DNA, 17 bp, Artificial sequence
  Synthetic oligonucleotide
ccagatttagccaccac

SEQ ID NO: 1142 - DNA, 17 bp, Artificial sequence
  Synthetic oligonucleotide
cccagatttagccacca

SEQ ID NO: 1143 - DNA, 17 bp, Artificial sequence
  Synthetic oligonucleotide
gcccagatttagccacc

SEQ ID NO: 1144 - DNA, 17 bp, Artificial sequence
  Synthetic oligonucleotide
agagaaactggtcctgc

SEQ ID NO: 1145 - DNA, 17 bp, Artificial sequence
  Synthetic oligonucleotide
cagagaaactggtcctg

SEQ ID NO: 1146 - DNA, 17 bp, Artificial sequence
  Synthetic oligonucleotide
gcagagaaactggtcct

SEQ ID NO: 1147 - DNA, 17 bp, Artificial sequence
  Synthetic oligonucleotide
catgtcatcagccaccc

SEQ ID NO: 1148 - DNA, 17 bp, Artificial sequence
  Synthetic oligonucleotide
ccatgtcatcagccacc

SEQ ID NO: 1149 - DNA, 17 bp, Artificial sequence
  Synthetic oligonucleotide
tccatgtcatcagccac

SEQ ID NO: 1150 - DNA, 17 bp, Artificial sequence
  Synthetic oligonucleotide
tgtgctgcatccatgtc

SEQ ID NO: 1151 - DNA, 17 bp, Artificial sequence
  Synthetic oligonucleotide
ctgtgctgcatccatgt

SEQ ID NO: 1152 - DNA, 17 bp, Artificial sequence
  Synthetic oligonucleotide
tctgtgctgcatccatg

SEQ ID NO: 1153 - DNA, 17 bp, Artificial sequence
  Synthetic oligonucleotide
tgagtctgtgctgcatc

SEQ ID NO: 1154 - DNA, 17 bp, Artificial sequence
  Synthetic oligonucleotide
ctgagtctgtgctgcat

SEQ ID NO: 1155 - DNA, 17 bp, Artificial sequence
  Synthetic oligonucleotide
gctgagtctgtgctgca

SEQ ID NO: 1156 - DNA, 17 bp, Artificial sequence
  Synthetic oligonucleotide
cacagaaaagtgaggct

SEQ ID NO: 1157 - DNA, 17 bp, Artificial sequence
  Synthetic oligonucleotide
gcacagaaaagtgaggc

SEQ ID NO: 1158 - DNA, 17 bp, Artificial sequence
  Synthetic oligonucleotide
ggcacagaaaagtgagg

SEQ ID NO: 1159 - DNA, 17 bp, Artificial sequence
  Synthetic oligonucleotide
aaagtctgacatggtgc

SEQ ID NO: 1160 - DNA, 17 bp, Artificial sequence
  Synthetic oligonucleotide
aaaagtctgacatggtg

SEQ ID NO: 1161 - DNA, 17 bp, Artificial sequence
  Synthetic oligonucleotide
caaaagtctgacatggt

SEQ ID NO: 1162 - DNA, 20 bp, Artificial sequence
  Synthetic oligonucleotide
gtgagatccccagagaggaa

SEQ ID NO: 1163 - DNA, 20 bp, Artificial sequence
  Synthetic oligonucleotide
aaggagtgagatccccagag

SEQ ID NO: 1164 - DNA, 20 bp, Artificial sequence
  Synthetic oligonucleotide
ttctgaccctattttccaga

SEQ ID NO: 1165 - DNA, 20 bp, Artificial sequence
  Synthetic oligonucleotide
ccctccatccttgagaatct

SEQ ID NO: 1166 - DNA, 20 bp, Artificial sequence
  Synthetic oligonucleotide
atgtcacaagttcacaaaca

SEQ ID NO: 1167 - DNA, 20 bp, Artificial sequence
  Synthetic oligonucleotide
catgaatgtcacaagttcac

SEQ ID NO: 1168 - DNA, 20 bp, Artificial sequence
  Synthetic oligonucleotide
actaacatgaatgtcacaag

SEQ ID NO: 1169 - DNA, 20 bp, Artificial sequence
  Synthetic oligonucleotide
caaggactaacatgaatgtc

SEQ ID NO: 1170 - DNA, 20 bp, Artificial sequence
  Synthetic oligonucleotide
aatgacaaggactaacatga

SEQ ID NO: 1171 - DNA, 20 bp, Artificial sequence
  Synthetic oligonucleotide
ggacaaatgacaaggactaa

SEQ ID NO: 1172 - DNA, 20 bp, Artificial sequence
  Synthetic oligonucleotide
acacaggacaaatgacaagg

SEQ ID NO: 1173 - DNA, 20 bp, Artificial sequence
  Synthetic oligonucleotide
gtgtaacacaggacaaatga

SEQ ID NO: 1174 - DNA, 20 bp, Artificial sequence
  Synthetic oligonucleotide
tgaatgtgtaacacaggaca

SEQ ID NO: 1175 - DNA, 20 bp, Artificial sequence
  Synthetic oligonucleotide
cagggtctgccactctctac

SEQ ID NO: 1176 - DNA, 20 bp, Artificial sequence
  Synthetic oligonucleotide
tagagcagggtctgccactc

SEQ ID NO: 1177 - DNA, 20 bp, Artificial sequence
  Synthetic oligonucleotide
tcagtgaagccttcctggat

SEQ ID NO: 1178 - DNA, 20 bp, Artificial sequence
  Synthetic oligonucleotide
cttcctcagtgaagccttcc

SEQ ID NO: 1179 - DNA, 20 bp, Artificial sequence
  Synthetic oligonucleotide
agtcccttcctcagtgaagc

SEQ ID NO: 1180 - DNA, 20 bp, Artificial sequence
  Synthetic oligonucleotide
ccccaagtcccttcctcagt

SEQ ID NO: 1181 - DNA, 20 bp, Artificial sequence
  Synthetic oligonucleotide
cacagtcatcttgtgtacat

SEQ ID NO: 1182 - DNA, 20 bp, Artificial sequence
  Synthetic oligonucleotide
ctctgcacagtcatcttgtg

SEQ ID NO: 1183 - DNA, 20 bp, Artificial sequence
  Synthetic oligonucleotide
gatcactctgcacagtcatc

SEQ ID NO: 1184 - DNA, 20 bp, Artificial sequence
  Synthetic oligonucleotide
gctcagatcactctgcacag

SEQ ID NO: 1185 - DNA, 20 bp, Artificial sequence
  Synthetic oligonucleotide
tcattgctcagatcactctg

SEQ ID NO: 1186 - DNA, 20 bp, Artificial sequence
  Synthetic oligonucleotide
tcctgtcattgctcagatca

SEQ ID NO: 1187 - DNA, 20 bp, Artificial sequence
  Synthetic oligonucleotide
gtctttcctgtcattgctca

SEQ ID NO: 1188 - DNA, 20 bp, Artificial sequence
  Synthetic oligonucleotide
tcagggtgatcaagctcccc

SEQ ID NO: 1189 - DNA, 20 bp, Artificial sequence
  Synthetic oligonucleotide
tgacctcagggtgatcaagc

SEQ ID NO: 1190 - DNA, 20 bp, Artificial sequence
  Synthetic oligonucleotide
ttccctgacctcagggtgat

SEQ ID NO: 1191 - DNA, 20 bp, Artificial sequence
  Synthetic oligonucleotide
aagacttccctgacctcagg

SEQ ID NO: 1192 - DNA, 20 bp, Artificial sequence
  Synthetic oligonucleotide
ccaggaagacttccctgacc

SEQ ID NO: 1193 - DNA, 20 bp, Artificial sequence
  Synthetic oligonucleotide
ctcttccaggaagacttccc

SEQ ID NO: 1194 - DNA, 20 bp, Artificial sequence
  Synthetic oligonucleotide
gtcacctcttccaggaagac

SEQ ID NO: 1195 - DNA, 20 bp, Artificial sequence
  Synthetic oligonucleotide
tgaatgtcacctcttccagg

SEQ ID NO: 1196 - DNA, 20 bp, Artificial sequence
  Synthetic oligonucleotide
cggactgaatgtcacctctt

SEQ ID NO: 1197 - DNA, 20 bp, Artificial sequence
  Synthetic oligonucleotide
agatccggactgaatgtcac

SEQ ID NO: 1198 - DNA, 20 bp, Artificial sequence
  Synthetic oligonucleotide
tttccagatccggactgaat

SEQ ID NO: 1199 - DNA, 20 bp, Artificial sequence
  Synthetic oligonucleotide
tcatctttccagatccggac

SEQ ID NO: 1200 - DNA, 20 bp, Artificial sequence
  Synthetic oligonucleotide
tctattcatctttccagatc

SEQ ID NO: 1201 - DNA, 20 bp, Artificial sequence
  Synthetic oligonucleotide
tgaatgttcttgcctgtctt

SEQ ID NO: 1202 - DNA, 20 bp, Artificial sequence
  Synthetic oligonucleotide
gtacctgaatgttcttgcct

SEQ ID NO: 1203 - DNA, 20 bp, Artificial sequence
  Synthetic oligonucleotide
ttcctgtacctgaatgttct

SEQ ID NO: 1204 - DNA, 20 bp, Artificial sequence
  Synthetic oligonucleotide
tgcctctcccatccaaatct

SEQ ID NO: 1205 - DNA, 20 bp, Artificial sequence
  Synthetic oligonucleotide
gttggtcactcagaggccct

SEQ ID NO: 1206 - DNA, 20 bp, Artificial sequence
  Synthetic oligonucleotide
acaggcctggatccagcatc

SEQ ID NO: 1207 - DNA, 20 bp, Artificial sequence
  Synthetic oligonucleotide
tcttcctcctgctgcagaca

SEQ ID NO: 1208 - DNA, 20 bp, Artificial sequence
  Synthetic oligonucleotide
tcaagtcttcctcctgctgc

SEQ ID NO: 1209 - DNA, 20 bp, Artificial sequence
  Synthetic oligonucleotide
agctctcaagtcttcctcct

SEQ ID NO: 1210 - DNA, 20 bp, Artificial sequence
  Synthetic oligonucleotide
ccatgagctctcaagtcttc

SEQ ID NO: 1211 - DNA, 20 bp, Artificial sequence
  Synthetic oligonucleotide
ctttcccatgagctctcaag

SEQ ID NO: 1212 - DNA, 20 bp, Artificial sequence
  Synthetic oligonucleotide
ggctcctttcccatgagctc

SEQ ID NO: 1213 - DNA, 20 bp, Artificial sequence
  Synthetic oligonucleotide
caccaggctcctttcccatg

SEQ ID NO: 1214 - DNA, 20 bp, Artificial sequence
  Synthetic oligonucleotide
aactgcaccaggctcctttc

SEQ ID NO: 1215 - DNA, 20 bp, Artificial sequence
  Synthetic oligonucleotide
aaactaactgcaccaggctc

SEQ ID NO: 1216 - DNA, 20 bp, Artificial sequence
  Synthetic oligonucleotide
ccaataaactaactgcacca

SEQ ID NO: 1217 - DNA, 20 bp, Artificial sequence
  Synthetic oligonucleotide
ggaggccaataaactaactg

SEQ ID NO: 1218 - DNA, 20 bp, Artificial sequence
  Synthetic oligonucleotide
gtgctggaggccaataaact

SEQ ID NO: 1219 - DNA, 20 bp, Artificial sequence
  Synthetic oligonucleotide
tcaaagtgctggaggccaat

SEQ ID NO: 1220 - DNA, 20 bp, Artificial sequence
  Synthetic oligonucleotide
agccagcagctccataccag

SEQ ID NO: 1221 - DNA, 20 bp, Artificial sequence
  Synthetic oligonucleotide
aaatcagccagcagctccat

SEQ ID NO: 1222 - DNA, 20 bp, Artificial sequence
  Synthetic oligonucleotide
ccctcaaatcagccagcagc

SEQ ID NO: 1223 - DNA, 20 bp, Artificial sequence
  Synthetic oligonucleotide
tgaggccctcaaatcagcca

SEQ ID NO: 1224 - DNA, 20 bp, Artificial sequence
  Synthetic oligonucleotide
gcccatgaggccctcaaatc

SEQ ID NO: 1225 - DNA, 20 bp, Artificial sequence
  Synthetic oligonucleotide
gccctgcccatgaggccctc

SEQ ID NO: 1226 - DNA, 20 bp, Artificial sequence
  Synthetic oligonucleotide
cctgggccctgcccatgagg

SEQ ID NO: 1227 - DNA, 20 bp, Artificial sequence
  Synthetic oligonucleotide
gccaagcaggagctggacag

SEQ ID NO: 1228 - DNA, 20 bp, Artificial sequence
  Synthetic oligonucleotide
tagtggcttgctgaggctgc

SEQ ID NO: 1229 - DNA, 20 bp, Artificial sequence
  Synthetic oligonucleotide
aagggtagtggcttgctgag

SEQ ID NO: 1230 - DNA, 20 bp, Artificial sequence
  Synthetic oligonucleotide
taaggaagggtagtggcttg

SEQ ID NO: 1231 - DNA, 20 bp, Artificial sequence
  Synthetic oligonucleotide
gagactgagggtaaggaagg

SEQ ID NO: 1232 - DNA, 20 bp, Artificial sequence
  Synthetic oligonucleotide
atgaggagactgagggtaag

SEQ ID NO: 1233 - DNA, 20 bp, Artificial sequence
  Synthetic oligonucleotide
catagatgaggagactgagg

SEQ ID NO: 1234 - DNA, 20 bp, Artificial sequence
  Synthetic oligonucleotide
catttcatagatgaggagac

SEQ ID NO: 1235 - DNA, 20 bp, Artificial sequence
  Synthetic oligonucleotide
ttgctcatttcatagatgag

SEQ ID NO: 1236 - DNA, 20 bp, Artificial sequence
  Synthetic oligonucleotide
cacttttgctcatttcatag

SEQ ID NO: 1237 - DNA, 20 bp, Artificial sequence
  Synthetic oligonucleotide
ataatctgcacaggttctta

SEQ ID NO: 1238 - DNA, 20 bp, Artificial sequence
  Synthetic oligonucleotide
gcaccataatctgcacaggt

SEQ ID NO: 1239 - DNA, 20 bp, Artificial sequence
  Synthetic oligonucleotide
gggtctaggtgagtgagaaa

SEQ ID NO: 1240 - DNA, 20 bp, Artificial sequence
  Synthetic oligonucleotide
atctggacctaatgtctgcc

SEQ ID NO: 1241 - DNA, 20 bp, Artificial sequence
  Synthetic oligonucleotide
ggcccatctggacctaatgt

SEQ ID NO: 1242 - DNA, 20 bp, Artificial sequence
  Synthetic oligonucleotide
acctgggcccatctggacct

SEQ ID NO: 1243 - DNA, 20 bp, Artificial sequence
  Synthetic oligonucleotide
ctcttgggctccttgaggca

SEQ ID NO: 1244 - DNA, 20 bp, Artificial sequence
  Synthetic oligonucleotide
acagcctcttgggctccttg

SEQ ID NO: 1245 - DNA, 20 bp, Artificial sequence
  Synthetic oligonucleotide
tgtgaacagcctcttgggct

SEQ ID NO: 1246 - DNA, 20 bp, Artificial sequence
  Synthetic oligonucleotide
agaggtgtgaacagcctctt

SEQ ID NO: 1247 - DNA, 20 bp, Artificial sequence
  Synthetic oligonucleotide
gccagaaagatgccagctaa

SEQ ID NO: 1248 - DNA, 20 bp, Artificial sequence
  Synthetic oligonucleotide
agagagccagaaagatgcca

SEQ ID NO: 1249 - DNA, 20 bp, Artificial sequence
  Synthetic oligonucleotide
aaaagggccagaatgtctgg

SEQ ID NO: 1250 - DNA, 20 bp, Artificial sequence
  Synthetic oligonucleotide
taaggaatctaaataactta

SEQ ID NO: 1251 - DNA, 20 bp, Artificial sequence
  Synthetic oligonucleotide
tgtcataaggaatctaaata

SEQ ID NO: 1252 - DNA, 20 bp, Artificial sequence
  Synthetic oligonucleotide
aggattgtcataaggaatct

SEQ ID NO: 1253 - DNA, 20 bp, Artificial sequence
  Synthetic oligonucleotide
aatccaggattgtcataagg

SEQ ID NO: 1254 - DNA, 20 bp, Artificial sequence
  Synthetic oligonucleotide
gctttaatccaggattgtca

SEQ ID NO: 1255 - DNA, 20 bp, Artificial sequence
  Synthetic oligonucleotide
ccttagctttaatccaggat

SEQ ID NO: 1256 - DNA, 20 bp, Artificial sequence
  Synthetic oligonucleotide
gtcctccttagctttaatcc

SEQ ID NO: 1257 - DNA, 20 bp, Artificial sequence
  Synthetic oligonucleotide
tcagtgtcctccttagcttt

SEQ ID NO: 1258 - DNA, 20 bp, Artificial sequence
  Synthetic oligonucleotide
gggactcagtgtcctcctta

SEQ ID NO: 1259 - DNA, 20 bp, Artificial sequence
  Synthetic oligonucleotide
tccctgggactcagtgtcct

SEQ ID NO: 1260 - DNA, 20 bp, Artificial sequence
  Synthetic oligonucleotide
gattcttacctgcaatgaga

SEQ ID NO: 1261 - DNA, 20 bp, Artificial sequence
  Synthetic oligonucleotide
gctctgattcttacctgcaa

SEQ ID NO: 1262 - DNA, 20 bp, Artificial sequence
  Synthetic oligonucleotide
ccctggctctgattcttacc

SEQ ID NO: 1263 - DNA, 20 bp, Artificial sequence
  Synthetic oligonucleotide
tcaaaccctggctctgattc

SEQ ID NO: 1264 - DNA, 20 bp, Artificial sequence
  Synthetic oligonucleotide
aggattcaaaccctggctct

SEQ ID NO: 1265 - DNA, 20 bp, Artificial sequence
  Synthetic oligonucleotide
atgcctgccctgcctaggaa

SEQ ID NO: 1266 - DNA, 20 bp, Artificial sequence
  Synthetic oligonucleotide
aaataatgcctgccctgcct

SEQ ID NO: 1267 - DNA, 20 bp, Artificial sequence
  Synthetic oligonucleotide
gggtaaaataatgcctgccc

SEQ ID NO: 1268 - DNA, 20 bp, Artificial sequence
  Synthetic oligonucleotide
ttgatgggtaaaataatgcc

SEQ ID NO: 1269 - DNA, 20 bp, Artificial sequence
  Synthetic oligonucleotide
cctgtttgatgggtaaaata

SEQ ID NO: 1270 - DNA, 20 bp, Artificial sequence
  Synthetic oligonucleotide
cctctcctgtttgatgggta

SEQ ID NO: 1271 - DNA, 20 bp, Artificial sequence
  Synthetic oligonucleotide
ggtgtcctctcctgtttgat

SEQ ID NO: 1272 - DNA, 20 bp, Artificial sequence
  Synthetic oligonucleotide
gcctcggtgtcctctcctgt

SEQ ID NO: 1273 - DNA, 20 bp, Artificial sequence
  Synthetic oligonucleotide
agtaagcctcggtgtcctct

SEQ ID NO: 1274 - DNA, 20 bp, Artificial sequence
  Synthetic oligonucleotide
taccaagtaagcctcggtgt

SEQ ID NO: 1275 - DNA, 20 bp, Artificial sequence
  Synthetic oligonucleotide
ttaattaccaagtaagcctc

SEQ ID NO: 1276 - DNA, 20 bp, Artificial sequence
  Synthetic oligonucleotide
ttcataaaaagtaaagatct

SEQ ID NO: 1277 - DNA, 20 bp, Artificial sequence
  Synthetic oligonucleotide
agagcttcataaaaagtaaa

SEQ ID NO: 1278 - DNA, 20 bp, Artificial sequence
  Synthetic oligonucleotide
agccaagagcttcataaaaa

SEQ ID NO: 1279 - DNA, 20 bp, Artificial sequence
  Synthetic oligonucleotide
tcaccagattgttgtgggaa

SEQ ID NO: 1280 - DNA, 20 bp, Artificial sequence
  Synthetic oligonucleotide
ctacctcaccagattgttgt

SEQ ID NO: 1281 - DNA, 20 bp, Artificial sequence
  Synthetic oligonucleotide
aatacctacctcaccagatt

SEQ ID NO: 1282 - DNA, 20 bp, Artificial sequence
  Synthetic oligonucleotide
gggctaatacctacctcacc

SEQ ID NO: 1283 - DNA, 20 bp, Artificial sequence
  Synthetic oligonucleotide
ttcctcatctatacagtggg

SEQ ID NO: 1284 - DNA, 20 bp, Artificial sequence
  Synthetic oligonucleotide
tcagcttcctcatctataca

SEQ ID NO: 1285 - DNA, 20 bp, Artificial sequence
  Synthetic oligonucleotide
aagcttcagcttcctcatct

SEQ ID NO: 1286 - DNA, 20 bp, Artificial sequence
  Synthetic oligonucleotide
tatacaagcttcagcttcct

SEQ ID NO: 1287 - DNA, 20 bp, Artificial sequence
  Synthetic oligonucleotide
cttcctatacaagcttcagc

SEQ ID NO: 1288 - DNA, 20 bp, Artificial sequence
  Synthetic oligonucleotide
agtcacttcctatacaagct

SEQ ID NO: 1289 - DNA, 20 bp, Artificial sequence
  Synthetic oligonucleotide
agaacctggcctctaactcg

SEQ ID NO: 1290 - DNA, 20 bp, Artificial sequence
  Synthetic oligonucleotide
catactggcatctggcaggg

SEQ ID NO: 1291 - DNA, 20 bp, Artificial sequence
  Synthetic oligonucleotide
acctccatactggcatctgg

SEQ ID NO: 1292 - DNA, 20 bp, Artificial sequence
  Synthetic oligonucleotide
acctcacctccatactggca

SEQ ID NO: 1293 - DNA, 20 bp, Artificial sequence
  Synthetic oligonucleotide
atgaagaaaaataatttggg

SEQ ID NO: 1294 - DNA, 20 bp, Artificial sequence
  Synthetic oligonucleotide
ttaacttctgctgagggaga

SEQ ID NO: 1295 - DNA, 20 bp, Artificial sequence
  Synthetic oligonucleotide
gatgcttaacttctgctgag

SEQ ID NO: 1296 - DNA, 20 bp, Artificial sequence
  Synthetic oligonucleotide
gttaggatgcttaacttctg

SEQ ID NO: 1297 - DNA, 20 bp, Artificial sequence
  Synthetic oligonucleotide
gttaagttaggatgcttaac

SEQ ID NO: 1298 - DNA, 20 bp, Artificial sequence
  Synthetic oligonucleotide
ataggcctggatgcccaagt

SEQ ID NO: 1299 - DNA, 20 bp, Artificial sequence
  Synthetic oligonucleotide
cagaggcagctataggcctg

SEQ ID NO: 1300 - DNA, 20 bp, Artificial sequence
  Synthetic oligonucleotide
tgcctcagaggcagctatag

SEQ ID NO: 1301 - DNA, 20 bp, Artificial sequence
  Synthetic oligonucleotide
tgtcctgcctcagaggcagc

SEQ ID NO: 1302 - DNA, 20 bp, Artificial sequence
  Synthetic oligonucleotide
gatgatgtcctgcctcagag

SEQ ID NO: 1303 - DNA, 20 bp, Artificial sequence
  Synthetic oligonucleotide
cagcagatgatgtcctgcct

SEQ ID NO: 1304 - DNA, 20 bp, Artificial sequence
  Synthetic oligonucleotide
gggacagagctaagacccaa

SEQ ID NO: 1305 - DNA, 20 bp, Artificial sequence
  Synthetic oligonucleotide
gtcaaaggtggcttcctggg

SEQ ID NO: 1306 - DNA, 20 bp, Artificial sequence
  Synthetic oligonucleotide
gagtagtcaaaggtggcttc

SEQ ID NO: 1307 - DNA, 20 bp, Artificial sequence
  Synthetic oligonucleotide
ggaatgagtagtcaaaggtg

SEQ ID NO: 1308 - DNA, 20 bp, Artificial sequence
  Synthetic oligonucleotide
aagttggaatgagtagtcaa

SEQ ID NO: 1309 - DNA, 20 bp, Artificial sequence
  Synthetic oligonucleotide
gctgagaataaagaagttgg

SEQ ID NO: 1310 - DNA, 20 bp, Artificial sequence
  Synthetic oligonucleotide
tagaagctgagaataaagaa

SEQ ID NO: 1311 - DNA, 20 bp, Artificial sequence
  Synthetic oligonucleotide
tgaaatagaagctgagaata

SEQ ID NO: 1312 - DNA, 20 bp, Artificial sequence
  Synthetic oligonucleotide
ggagttctaatgaggcagac

SEQ ID NO: 1313 - DNA, 20 bp, Artificial sequence
  Synthetic oligonucleotide
tgcagggagttctaatgagg

SEQ ID NO: 1314 - DNA, 20 bp, Artificial sequence
  Synthetic oligonucleotide
agccttgcagggagttctaa

SEQ ID NO: 1315 - DNA, 20 bp, Artificial sequence
  Synthetic oligonucleotide
aacaaagccttgcagggagt

SEQ ID NO: 1316 - DNA, 20 bp, Artificial sequence
  Synthetic oligonucleotide
atggcaagtgcttccgtggg

SEQ ID NO: 1317 - DNA, 20 bp, Artificial sequence
  Synthetic oligonucleotide
accaaatggcaagtgcttcc

SEQ ID NO: 1318 - DNA, 20 bp, Artificial sequence
  Synthetic oligonucleotide
caaataccaaatggcaagtg

SEQ ID NO: 1319 - DNA, 20 bp, Artificial sequence
  Synthetic oligonucleotide
ctgcaaggtggtgagctcta

SEQ ID NO: 1320 - DNA, 20 bp, Artificial sequence
  Synthetic oligonucleotide
cctcacttcccatctgcctg

SEQ ID NO: 1321 - DNA, 20 bp, Artificial sequence
  Synthetic oligonucleotide
tgaaccctcacttcccatct

SEQ ID NO: 1322 - DNA, 20 bp, Artificial sequence
  Synthetic oligonucleotide
ccaagtgaaccctcacttcc

SEQ ID NO: 1323 - DNA, 20 bp, Artificial sequence
  Synthetic oligonucleotide
gtctaccaagtgaaccctca

SEQ ID NO: 1324 - DNA, 20 bp, Artificial sequence
  Synthetic oligonucleotide
atgcagtctaccaagtgaac

SEQ ID NO: 1325 - DNA, 20 bp, Artificial sequence
  Synthetic oligonucleotide
gggaaatgcagtctaccaag

SEQ ID NO: 1326 - DNA, 20 bp, Artificial sequence
  Synthetic oligonucleotide
caagtgggaaatgcagtcta

SEQ ID NO: 1327 - DNA, 20 bp, Artificial sequence
  Synthetic oligonucleotide
gccaacaagtgggaaatgca

SEQ ID NO: 1328 - DNA, 20 bp, Artificial sequence
  Synthetic oligonucleotide
ccaactaccgcccacagctc

SEQ ID NO: 1329 - DNA, 20 bp, Artificial sequence
  Synthetic oligonucleotide
cagccccaactaccgcccac

SEQ ID NO: 1330 - DNA, 20 bp, Artificial sequence
  Synthetic oligonucleotide
ttatccagccccaactaccg

SEQ ID NO: 1331 - DNA, 20 bp, Artificial sequence
  Synthetic oligonucleotide
ctgccttatccagccccaac

SEQ ID NO: 1332 - DNA, 20 bp, Artificial sequence
  Synthetic oligonucleotide
tcaccctgccttatccagcc

SEQ ID NO: 1333 - DNA, 20 bp, Artificial sequence
  Synthetic oligonucleotide
tcttgttcaaccctcacccc

SEQ ID NO: 1334 - DNA, 20 bp, Artificial sequence
  Synthetic oligonucleotide
cttattaggtgtcttaaaat

SEQ ID NO: 1335 - DNA, 20 bp, Artificial sequence
  Synthetic oligonucleotide
ctaagcttattaggtgtctt

SEQ ID NO: 1336 - DNA, 20 bp, Artificial sequence
  Synthetic oligonucleotide
ctctgctaagcttattaggt

SEQ ID NO: 1337 - DNA, 20 bp, Artificial sequence
  Synthetic oligonucleotide
actgagaagacctaaaaatt

SEQ ID NO: 1338 - DNA, 20 bp, Artificial sequence
  Synthetic oligonucleotide
aaacaactgagaagacctaa

SEQ ID NO: 1339 - DNA, 20 bp, Artificial sequence
  Synthetic oligonucleotide
aactgaaacaactgagaaga

SEQ ID NO: 1340 - DNA, 20 bp, Artificial sequence
  Synthetic oligonucleotide
tccccaactgaaacaactga

SEQ ID NO: 1341 - DNA, 20 bp, Artificial sequence
  Synthetic oligonucleotide
gacatatccccaactgaaac

SEQ ID NO: 1342 - DNA, 20 bp, Artificial sequence
  Synthetic oligonucleotide
ctgatgacatatccccaact

SEQ ID NO: 1343 - DNA, 20 bp, Artificial sequence
  Synthetic oligonucleotide
tttcactgatgacatatccc

SEQ ID NO: 1344 - DNA, 20 bp, Artificial sequence
  Synthetic oligonucleotide
agaaatttcactgatgacat

SEQ ID NO: 1345 - DNA, 20 bp, Artificial sequence
  Synthetic oligonucleotide
agtatagaaatttcactgat

SEQ ID NO: 1346 - DNA, 20 bp, Artificial sequence
  Synthetic oligonucleotide
ggaggagtatagaaatttca

SEQ ID NO: 1347 - DNA, 20 bp, Artificial sequence
  Synthetic oligonucleotide
ttggaggaggagtatagaaa

SEQ ID NO: 1348 - DNA, 20 bp, Artificial sequence
  Synthetic oligonucleotide
gcagcttggaggaggagtat

SEQ ID NO: 1349 - DNA, 20 bp, Artificial sequence
  Synthetic oligonucleotide
cccatgcagcttggaggagg

SEQ ID NO: 1350 - DNA, 20 bp, Artificial sequence
  Synthetic oligonucleotide
cagcccccatgcagcttgga

SEQ ID NO: 1351 - DNA, 20 bp, Artificial sequence
  Synthetic oligonucleotide
agggccagcccccatgcagc

SEQ ID NO: 1352 - DNA, 20 bp, Artificial sequence
  Synthetic oligonucleotide
ttatctagctccctaccttg

SEQ ID NO: 1353 - DNA, 20 bp, Artificial sequence
  Synthetic oligonucleotide
tgaagccagtggtttgaggg

SEQ ID NO: 1354 - DNA, 20 bp, Artificial sequence
  Synthetic oligonucleotide
tgcttcccgttgcagacagg

SEQ ID NO: 1355 - DNA, 20 bp, Artificial sequence
  Synthetic oligonucleotide
gtccaaacactcaggtaggg

SEQ ID NO: 1356 - DNA, 20 bp, Artificial sequence
  Synthetic oligonucleotide
cttcagtccaaacactcagg

SEQ ID NO: 1357 - DNA, 20 bp, Artificial sequence
  Synthetic oligonucleotide
ttaagtctgagaaacaccac

SEQ ID NO: 1358 - DNA, 20 bp, Artificial sequence
  Synthetic oligonucleotide
ggtgattaagtctgagaaac

SEQ ID NO: 1359 - DNA, 20 bp, Artificial sequence
  Synthetic oligonucleotide
ccccaggtgattaagtctga

SEQ ID NO: 1360 - DNA, 20 bp, Artificial sequence
  Synthetic oligonucleotide
aagatccccaggtgattaag

SEQ ID NO: 1361 - DNA, 20 bp, Artificial sequence
  Synthetic oligonucleotide
ttaacaagatccccaggtga

SEQ ID NO: 1362 - DNA, 20 bp, Artificial sequence
  Synthetic oligonucleotide
tgcattttaacaagatcccc

SEQ ID NO: 1363 - DNA, 20 bp, Artificial sequence
  Synthetic oligonucleotide
aaatctgcattttaacaaga

SEQ ID NO: 1364 - DNA, 20 bp, Artificial sequence
  Synthetic oligonucleotide
aatcaaaatctgcattttaa

SEQ ID NO: 1365 - DNA, 20 bp, Artificial sequence
  Synthetic oligonucleotide
tactgaatcaaaatctgcat

SEQ ID NO: 1366 - DNA, 20 bp, Artificial sequence
  Synthetic oligonucleotide
ggatttactgaatcaaaatc

SEQ ID NO: 1367 - DNA, 20 bp, Artificial sequence
  Synthetic oligonucleotide
agactggatttactgaatca

SEQ ID NO: 1368 - DNA, 20 bp, Artificial sequence
  Synthetic oligonucleotide
gctccagactggatttactg

SEQ ID NO: 1369 - DNA, 20 bp, Artificial sequence
  Synthetic oligonucleotide
agcagcatcagcatcacctg

SEQ ID NO: 1370 - DNA, 20 bp, Artificial sequence
  Synthetic oligonucleotide
ggaacagcagcatcagcatc

SEQ ID NO: 1371 - DNA, 20 bp, Artificial sequence
  Synthetic oligonucleotide
gtctgggaacagcagcatca

SEQ ID NO: 1372 - DNA, 20 bp, Artificial sequence
  Synthetic oligonucleotide
tactctagcactttcctact

SEQ ID NO: 1373 - DNA, 20 bp, Artificial sequence
  Synthetic oligonucleotide
aaatgtactctagcactttc

SEQ ID NO: 1374 - DNA, 20 bp, Artificial sequence
  Synthetic oligonucleotide
agacaaaatgtactctagca

SEQ ID NO: 1375 - DNA, 20 bp, Artificial sequence
  Synthetic oligonucleotide
ggctggatgccctggctaga

SEQ ID NO: 1376 - DNA, 20 bp, Artificial sequence
  Synthetic oligonucleotide
aggcaggctggatgccctgg

SEQ ID NO: 1377 - DNA, 20 bp, Artificial sequence
  Synthetic oligonucleotide
atctgaggcaggctggatgc

SEQ ID NO: 1378 - DNA, 20 bp, Artificial sequence
  Synthetic oligonucleotide
atcttccagcagctggctct

SEQ ID NO: 1379 - DNA, 20 bp, Artificial sequence
  Synthetic oligonucleotide
aagtcatcttccagcagctg

SEQ ID NO: 1380 - DNA, 20 bp, Artificial sequence
  Synthetic oligonucleotide
tggacaagtcatcttccagc

SEQ ID NO: 1381 - DNA, 20 bp, Artificial sequence
  Synthetic oligonucleotide
aagtccaagcacaggcttga

SEQ ID NO: 1382 - DNA, 20 bp, Artificial sequence
  Synthetic oligonucleotide
aagtgaagtccaagcacagg

SEQ ID NO: 1383 - DNA, 20 bp, Artificial sequence
  Synthetic oligonucleotide
gagggaagtgaagtccaagc

SEQ ID NO: 1384 - DNA, 20 bp, Artificial sequence
  Synthetic oligonucleotide
tccttgagggtctcataacc

SEQ ID NO: 1385 - DNA, 20 bp, Artificial sequence
  Synthetic oligonucleotide
gcttatccttgagggtctca

SEQ ID NO: 1386 - DNA, 20 bp, Artificial sequence
  Synthetic oligonucleotide
cacatgcttatccttgaggg

SEQ ID NO: 1387 - DNA, 20 bp, Artificial sequence
  Synthetic oligonucleotide
ttcatcacatgcttatcctt

SEQ ID NO: 1388 - DNA, 20 bp, Artificial sequence
  Synthetic oligonucleotide
atgagttcatcacatgctta

SEQ ID NO: 1389 - DNA, 20 bp, Artificial sequence
  Synthetic oligonucleotide
tcaacctgcccagcagtggg

SEQ ID NO: 1390 - DNA, 20 bp, Artificial sequence
  Synthetic oligonucleotide
ctctgtacacaggacacagt

SEQ ID NO: 1391 - DNA, 20 bp, Artificial sequence
  Synthetic oligonucleotide
aaaggctctgtacacaggac

SEQ ID NO: 1392 - DNA, 20 bp, Artificial sequence
  Synthetic oligonucleotide
agtgcaaaggctctgtacac

SEQ ID NO: 1393 - DNA, 20 bp, Artificial sequence
  Synthetic oligonucleotide
ggcaacctaaggagtgaggg

SEQ ID NO: 1394 - DNA, 20 bp, Artificial sequence
  Synthetic oligonucleotide
tggatggcaacctaaggagt

SEQ ID NO: 1395 - DNA, 20 bp, Artificial sequence
  Synthetic oligonucleotide
tggcctggatggcaacctaa

SEQ ID NO: 1396 - DNA, 20 bp, Artificial sequence
  Synthetic oligonucleotide
gctatgctgagagcacaggg

SEQ ID NO: 1397 - DNA, 20 bp, Artificial sequence
  Synthetic oligonucleotide
tacctgctatgctgagagca

SEQ ID NO: 1398 - DNA, 20 bp, Artificial sequence
  Synthetic oligonucleotide
gaagctacctgctatgctga

SEQ ID NO: 1399 - DNA, 20 bp, Artificial sequence
  Synthetic oligonucleotide
ctgaggaagctacctgctat

SEQ ID NO: 1400 - DNA, 20 bp, Artificial sequence
  Synthetic oligonucleotide
caggttcatctgccttgacg

SEQ ID NO: 1401 - DNA, 20 bp, Artificial sequence
  Synthetic oligonucleotide
tggagcaggttcatctgcct

SEQ ID NO: 1402 - DNA, 20 bp, Artificial sequence
  Synthetic oligonucleotide
tgctctggagcaggttcatc

SEQ ID NO: 1403 - DNA, 20 bp, Artificial sequence
  Synthetic oligonucleotide
tgtgatgctctggagcaggt

SEQ ID NO: 1404 - DNA, 20 bp, Artificial sequence
  Synthetic oligonucleotide
cactctgtgatgctctggag

SEQ ID NO: 1405 - DNA, 20 bp, Artificial sequence
  Synthetic oligonucleotide
gaatgcactctgtgatgctc

SEQ ID NO: 1406 - DNA, 20 bp, Artificial sequence
  Synthetic oligonucleotide
cagagggactggctcacagg

SEQ ID NO: 1407 - DNA, 20 bp, Artificial sequence
  Synthetic oligonucleotide
tacagtcccgaagagtgggt

SEQ ID NO: 1408 - DNA, 20 bp, Artificial sequence
  Synthetic oligonucleotide
gcctatacagtcccgaagag

SEQ ID NO: 1409 - DNA, 20 bp, Artificial sequence
  Synthetic oligonucleotide
taccagcctatacagtcccg

SEQ ID NO: 1410 - DNA, 20 bp, Artificial sequence
  Synthetic oligonucleotide
tcccctaccagcctatacag

SEQ ID NO: 1411 - DNA, 20 bp, Artificial sequence
  Synthetic oligonucleotide
gatgatcccctaccagccta

SEQ ID NO: 1412 - DNA, 20 bp, Artificial sequence
  Synthetic oligonucleotide
gtcctgatgatcccctacca

SEQ ID NO: 1413 - DNA, 20 bp, Artificial sequence
  Synthetic oligonucleotide
ggtaagtcctgatgatcccc

SEQ ID NO: 1414 - DNA, 20 bp, Artificial sequence
  Synthetic oligonucleotide
gacatggtaagtcctgatga

SEQ ID NO: 1415 - DNA, 20 bp, Artificial sequence
  Synthetic oligonucleotide
gcactgacatggtaagtcct

SEQ ID NO: 1416 - DNA, 20 bp, Artificial sequence
  Synthetic oligonucleotide
gctcagcactgacatggtaa

SEQ ID NO: 1417 - DNA, 20 bp, Artificial sequence
  Synthetic oligonucleotide
cagctgctcagcactgacat

SEQ ID NO: 1418 - DNA, 20 bp, Artificial sequence
  Synthetic oligonucleotide
aaggacagctgctcagcact

SEQ ID NO: 1419 - DNA, 20 bp, Artificial sequence
  Synthetic oligonucleotide
gtgaagttctatcccttggc

SEQ ID NO: 1420 - DNA, 20 bp, Artificial sequence
  Synthetic oligonucleotide
cacctgtgaagttctatccc

SEQ ID NO: 1421 - DNA, 20 bp, Artificial sequence
  Synthetic oligonucleotide
tttctcacctgtgaagttct

SEQ ID NO: 1422 - DNA, 20 bp, Artificial sequence
  Synthetic oligonucleotide
agcaggtagttgatgaacct

SEQ ID NO: 1423 - DNA, 20 bp, Artificial sequence
  Synthetic oligonucleotide
tgccatttaatgagcttcac

SEQ ID NO: 1424 - DNA, 20 bp, Artificial sequence
  Synthetic oligonucleotide
aactctgccatttaatgagc

SEQ ID NO: 1425 - DNA, 20 bp, Artificial sequence
  Synthetic oligonucleotide
atcccaactctgccatttaa

SEQ ID NO: 1426 - DNA, 20 bp, Artificial sequence
  Synthetic oligonucleotide
gaatgcactgagtttctgct

SEQ ID NO: 1427 - DNA, 20 bp, Artificial sequence
  Synthetic oligonucleotide
cactaattctgggcttccag

SEQ ID NO: 1428 - DNA, 20 bp, Artificial sequence
  Synthetic oligonucleotide
cagttcactaattctgggct

SEQ ID NO: 1429 - DNA, 20 bp, Artificial sequence
  Synthetic oligonucleotide
agccccagttcactaattct

SEQ ID NO: 1430 - DNA, 20 bp, Artificial sequence
  Synthetic oligonucleotide
gtttcagccccagttcacta

SEQ ID NO: 1431 - DNA, 20 bp, Artificial sequence
  Synthetic oligonucleotide
tggctgtttcagccccagtt

SEQ ID NO: 1432 - DNA, 20 bp, Artificial sequence
  Synthetic oligonucleotide
aagactggctgtttcagccc

SEQ ID NO: 1433 - DNA, 20 bp, Artificial sequence
  Synthetic oligonucleotide
aggtgaagactggctgtttc

SEQ ID NO: 1434 - DNA, 20 bp, Artificial sequence
  Synthetic oligonucleotide
cctaaaggtgaagactggct

SEQ ID NO: 1435 - DNA, 20 bp, Artificial sequence
  Synthetic oligonucleotide
ttgggcctaaaggtgaagac

SEQ ID NO: 1436 - DNA, 20 bp, Artificial sequence
  Synthetic oligonucleotide
cgttcttgggcctaaaggtg

SEQ ID NO: 1437 - DNA, 20 bp, Artificial sequence
  Synthetic oligonucleotide
aagcccgttcttgggcctaa

SEQ ID NO: 1438 - DNA, 20 bp, Artificial sequence
  Synthetic oligonucleotide
ttaagggttcatggatcccc

SEQ ID NO: 1439 - DNA, 20 bp, Artificial sequence
  Synthetic oligonucleotide
taattttaagggttcatgga

SEQ ID NO: 1440 - DNA, 20 bp, Artificial sequence
  Synthetic oligonucleotide
ctgtaagactttgaggacag

SEQ ID NO: 1441 - DNA, 20 bp, Artificial sequence
  Synthetic oligonucleotide
tgtccctgtaagactttgag

SEQ ID NO: 1442 - DNA, 20 bp, Artificial sequence
  Synthetic oligonucleotide
gttcttccaaccagtgtttg

SEQ ID NO: 1443 - DNA, 20 bp, Artificial sequence
  Synthetic oligonucleotide
gctcagttcttccaaccagt

SEQ ID NO: 1444 - DNA, 20 bp, Artificial sequence
  Synthetic oligonucleotide
agtttgctcagttcttccaa

SEQ ID NO: 1445 - DNA, 20 bp, Artificial sequence
  Synthetic oligonucleotide
tgtttagtttgctcagttct

SEQ ID NO: 1446 - DNA, 20 bp, Artificial sequence
  Synthetic oligonucleotide
aaatgcaagccatgttaggg

SEQ ID NO: 1447 - DNA, 20 bp, Artificial sequence
  Synthetic oligonucleotide
tggccaaatgcaagccatgt

SEQ ID NO: 1448 - DNA, 20 bp, Artificial sequence
  Synthetic oligonucleotide
gtaagtggccaaatgcaagc

SEQ ID NO: 1449 - DNA, 20 bp, Artificial sequence
  Synthetic oligonucleotide
ttctagtaagtggccaaatg

SEQ ID NO: 1450 - DNA, 20 bp, Artificial sequence
  Synthetic oligonucleotide
caggcctccacttccttttt

SEQ ID NO: 1451 - DNA, 20 bp, Artificial sequence
  Synthetic oligonucleotide
tcttctcatgtgaccccaag

SEQ ID NO: 1452 - DNA, 20 bp, Artificial sequence
  Synthetic oligonucleotide
tactttcttctcatgtgacc

SEQ ID NO: 1453 - DNA, 20 bp, Artificial sequence
  Synthetic oligonucleotide
cccagtactttcttctcatg

SEQ ID NO: 1454 - DNA, 20 bp, Artificial sequence
  Synthetic oligonucleotide
ctggtcccagtactttcttc

SEQ ID NO: 1455 - DNA, 20 bp, Artificial sequence
  Synthetic oligonucleotide
ttgtcctggtcccagtactt

SEQ ID NO: 1456 - DNA, 20 bp, Artificial sequence
  Synthetic oligonucleotide
ggttcttgtcctggtcccag

SEQ ID NO: 1457 - DNA, 20 bp, Artificial sequence
  Synthetic oligonucleotide
ccctgggttcttgtcctggt

SEQ ID NO: 1458 - DNA, 20 bp, Artificial sequence
  Synthetic oligonucleotide
ggagtccctgggttcttgtc

SEQ ID NO: 1459 - DNA, 20 bp, Artificial sequence
  Synthetic oligonucleotide
aggctggagtccctgggttc

SEQ ID NO: 1460 - DNA, 20 bp, Artificial sequence
  Synthetic oligonucleotide
ctgggaggctggagtccctg

SEQ ID NO: 1461 - DNA, 20 bp, Artificial sequence
  Synthetic oligonucleotide
accagccaggcccagaccca

SEQ ID NO: 1462 - DNA, 20 bp, Artificial sequence
  Synthetic oligonucleotide
tccctaccagccaggcccag

SEQ ID NO: 1463 - DNA, 20 bp, Artificial sequence
  Synthetic oligonucleotide
tcagctccctaccagccagg

SEQ ID NO: 1464 - DNA, 20 bp, Artificial sequence
  Synthetic oligonucleotide
gctgctcagctccctaccag

SEQ ID NO: 1465 - DNA, 20 bp, Artificial sequence
  Synthetic oligonucleotide
tacaagctgctcagctccct

SEQ ID NO: 1466 - DNA, 20 bp, Artificial sequence
  Synthetic oligonucleotide
tgttctacaagctgctcagc

SEQ ID NO: 1467 - DNA, 20 bp, Artificial sequence
  Synthetic oligonucleotide
gctggtgttctacaagctgc

SEQ ID NO: 1468 - DNA, 20 bp, Artificial sequence
  Synthetic oligonucleotide
cgtgagctggtgttctacaa

SEQ ID NO: 1469 - DNA, 20 bp, Artificial sequence
  Synthetic oligonucleotide
tctgatcaattattaaccta

SEQ ID NO: 1470 - DNA, 20 bp, Artificial sequence
  Synthetic oligonucleotide
tggatgtagactctccatga

SEQ ID NO: 1471 - DNA, 20 bp, Artificial sequence
  Synthetic oligonucleotide
aaggctggatgtagactctc

SEQ ID NO: 1472 - DNA, 20 bp, Artificial sequence
  Synthetic oligonucleotide
aagataaggctggatgtaga

SEQ ID NO: 1473 - DNA, 20 bp, Artificial sequence
  Synthetic oligonucleotide
gggagaagataaggctggat

SEQ ID NO: 1474 - DNA, 20 bp, Artificial sequence
  Synthetic oligonucleotide
cccatgggagaagataaggc

SEQ ID NO: 1475 - DNA, 20 bp, Artificial sequence
  Synthetic oligonucleotide
ggtttcccatgggagaagat

SEQ ID NO: 1476 - DNA, 20 bp, Artificial sequence
  Synthetic oligonucleotide
catgctctcttctcaccatg

SEQ ID NO: 1477 - DNA, 20 bp, Artificial sequence
  Synthetic oligonucleotide
gatgtcatgctctcttctca

SEQ ID NO: 1478 - DNA, 20 bp, Artificial sequence
  Synthetic oligonucleotide
ctctggatgtcatgctctct

SEQ ID NO: 1479 - DNA, 20 bp, Artificial sequence
  Synthetic oligonucleotide
ccaggtgctgtaggctgcct

SEQ ID NO: 1480 - DNA, 20 bp, Artificial sequence
  Synthetic oligonucleotide
tggtcccaggtgctgtaggc

SEQ ID NO: 1481 - DNA, 20 bp, Artificial sequence
  Synthetic oligonucleotide
cctggtggtcccaggtgctg

SEQ ID NO: 1482 - DNA, 20 bp, Artificial sequence
  Synthetic oligonucleotide
aggccaacccttgctgtgtg

SEQ ID NO: 1483 - DNA, 20 bp, Artificial sequence
  Synthetic oligonucleotide
aagggaggccaacccttgct

SEQ ID NO: 1484 - DNA, 20 bp, Artificial sequence
  Synthetic oligonucleotide
taggactttttccactgccc

SEQ ID NO: 1485 - DNA, 20 bp, Artificial sequence
  Synthetic oligonucleotide
ccttctaggactttttccac

SEQ ID NO: 1486 - DNA, 20 bp, Artificial sequence
  Synthetic oligonucleotide
gtttggtgggagaagcatgg

SEQ ID NO: 1487 - DNA, 20 bp, Artificial sequence
  Synthetic oligonucleotide
ctcatgtttggtgggagaag

SEQ ID NO: 1488 - DNA, 20 bp, Artificial sequence
  Synthetic oligonucleotide
aggtactcatgtttggtggg

SEQ ID NO: 1489 - DNA, 20 bp, Artificial sequence
  Synthetic oligonucleotide
gcagcaggtactcatgtttg

SEQ ID NO: 1490 - DNA, 20 bp, Artificial sequence
  Synthetic oligonucleotide
caagggcagcaggtactcat

SEQ ID NO: 1491 - DNA, 20 bp, Artificial sequence
  Synthetic oligonucleotide
acatatcatctcttgcctgt

SEQ ID NO: 1492 - DNA, 20 bp, Artificial sequence
  Synthetic oligonucleotide
tatctacatatcatctcttg

SEQ ID NO: 1493 - DNA, 20 bp, Artificial sequence
  Synthetic oligonucleotide
catactatctacatatcatc

SEQ ID NO: 1494 - DNA, 20 bp, Artificial sequence
  Synthetic oligonucleotide
aatatcatactatctacata

SEQ ID NO: 1495 - DNA, 20 bp, Artificial sequence
  Synthetic oligonucleotide
tccccaatatcatactatct

SEQ ID NO: 1496 - DNA, 20 bp, Artificial sequence
  Synthetic oligonucleotide
acctcagctcttcaagaagt

SEQ ID NO: 1497 - DNA, 20 bp, Artificial sequence
  Synthetic oligonucleotide
ctcagacctcagctcttcaa

SEQ ID NO: 1498 - DNA, 20 bp, Artificial sequence
  Synthetic oligonucleotide
cctatctcagacctcagctc

SEQ ID NO: 1499 - DNA, 20 bp, Artificial sequence
  Synthetic oligonucleotide
taaggcctatctcagacctc

SEQ ID NO: 1500 - DNA, 20 bp, Artificial sequence
  Synthetic oligonucleotide
acctttaaggcctatctcag

SEQ ID NO: 1501 - DNA, 20 bp, Artificial sequence
  Synthetic oligonucleotide
acccaacctttaaggcctat

SEQ ID NO: 1502 - DNA, 20 bp, Artificial sequence
  Synthetic oligonucleotide
tttttacccaacctttaagg

SEQ ID NO: 1503 - DNA, 20 bp, Artificial sequence
  Synthetic oligonucleotide
tccattttttacccaacctt

SEQ ID NO: 1504 - DNA, 20 bp, Artificial sequence
  Synthetic oligonucleotide
ctctttccattttttaccca

SEQ ID NO: 1505 - DNA, 20 bp, Artificial sequence
  Synthetic oligonucleotide
cttctctctttccatttttt

SEQ ID NO: 1506 - DNA, 20 bp, Artificial sequence
  Synthetic oligonucleotide
cagggcttctctctttccat

SEQ ID NO: 1507 - DNA, 20 bp, Artificial sequence
  Synthetic oligonucleotide
ctcagcagggcttctctctt

SEQ ID NO: 1508 - DNA, 20 bp, Artificial sequence
  Synthetic oligonucleotide
ctgccctcagcagggcttct

SEQ ID NO: 1509 - DNA, 20 bp, Artificial sequence
  Synthetic oligonucleotide
actagctgccctcagcaggg

SEQ ID NO: 1510 - DNA, 20 bp, Artificial sequence
  Synthetic oligonucleotide
ttgtgccatgcctgctttat

SEQ ID NO: 1511 - DNA, 20 bp, Artificial sequence
  Synthetic oligonucleotide
gcagagcccatcagcctccc

SEQ ID NO: 1512 - DNA, 20 bp, Artificial sequence
  Synthetic oligonucleotide
aaagcgcagagcccatcagc

SEQ ID NO: 1513 - DNA, 20 bp, Artificial sequence
  Synthetic oligonucleotide
ctggctcccttccaacataa

SEQ ID NO: 1514 - DNA, 20 bp, Artificial sequence
  Synthetic oligonucleotide
gagggctggctcccttccaa

SEQ ID NO: 1515 - DNA, 20 bp, Artificial sequence
  Synthetic oligonucleotide
aggaggagggctggctccct

SEQ ID NO: 1516 - DNA, 20 bp, Artificial sequence
  Synthetic oligonucleotide
tgcccaggaggagggctggc

SEQ ID NO: 1517 - DNA, 20 bp, Artificial sequence
  Synthetic oligonucleotide
taggctttagaaattcacca

SEQ ID NO: 1518 - DNA, 20 bp, Artificial sequence
  Synthetic oligonucleotide
caggtctgactctacagtcc

SEQ ID NO: 1519 - DNA, 20 bp, Artificial sequence
  Synthetic oligonucleotide
aaacacaggtctgactctac

SEQ ID NO: 1520 - DNA, 20 bp, Artificial sequence
  Synthetic oligonucleotide
gattcaaacacaggtctgac

SEQ ID NO: 1521 - DNA, 20 bp, Artificial sequence
  Synthetic oligonucleotide
gccaggattcaaacacaggt

SEQ ID NO: 1522 - DNA, 20 bp, Artificial sequence
  Synthetic oligonucleotide
gcagagccaggattcaaaca

SEQ ID NO: 1523 - DNA, 20 bp, Artificial sequence
  Synthetic oligonucleotide
cagtggcagagccaggattc

SEQ ID NO: 1524 - DNA, 20 bp, Artificial sequence
  Synthetic oligonucleotide
caggacagtggcagagccag

SEQ ID NO: 1525 - DNA, 20 bp, Artificial sequence
  Synthetic oligonucleotide
cccagcaggacagtggcaga

SEQ ID NO: 1526 - DNA, 20 bp, Artificial sequence
  Synthetic oligonucleotide
ggtcacccagcaggacagtg

SEQ ID NO: 1527 - DNA, 20 bp, Artificial sequence
  Synthetic oligonucleotide
cccaaggtcacccagcagga

SEQ ID NO: 1528 - DNA, 20 bp, Artificial sequence
  Synthetic oligonucleotide
acttgcccaaggtcacccag

SEQ ID NO: 1529 - DNA, 20 bp, Artificial sequence
  Synthetic oligonucleotide
agataacttgcccaaggtca

SEQ ID NO: 1530 - DNA, 20 bp, Artificial sequence
  Synthetic oligonucleotide
ttgccccattttagagataa

SEQ ID NO: 1531 - DNA, 20 bp, Artificial sequence
  Synthetic oligonucleotide
tgactttgccccattttaga

SEQ ID NO: 1532 - DNA, 20 bp, Artificial sequence
  Synthetic oligonucleotide
gcagggtgactttgccccat

SEQ ID NO: 1533 - DNA, 20 bp, Artificial sequence
  Synthetic oligonucleotide
tgagccactgtctcaagtgt

SEQ ID NO: 1534 - DNA, 20 bp, Artificial sequence
  Synthetic oligonucleotide
tgcctctgcatctcaagact

SEQ ID NO: 1535 - DNA, 20 bp, Artificial sequence
  Synthetic oligonucleotide
cccagtgcctctgcatctca

SEQ ID NO: 1536 - DNA, 20 bp, Artificial sequence
  Synthetic oligonucleotide
ccagcccagacactgtggat

SEQ ID NO: 1537 - DNA, 20 bp, Artificial sequence
  Synthetic oligonucleotide
agcacccagcccagacactg

SEQ ID NO: 1538 - DNA, 20 bp, Artificial sequence
  Synthetic oligonucleotide
tactgtcccctccttgtgtg

SEQ ID NO: 1539 - DNA, 20 bp, Artificial sequence
  Synthetic oligonucleotide
ttcagcttcttgtgaagctg

SEQ ID NO: 1540 - DNA, 20 bp, Artificial sequence
  Synthetic oligonucleotide
taggcttcagcttcttgtga

SEQ ID NO: 1541 - DNA, 20 bp, Artificial sequence
  Synthetic oligonucleotide
ggagataggcttcagcttct

SEQ ID NO: 1542 - DNA, 20 bp, Artificial sequence
  Synthetic oligonucleotide
ccaaaggagataggcttcag

SEQ ID NO: 1543 - DNA, 20 bp, Artificial sequence
  Synthetic oligonucleotide
agcagattcctgggacaaga

SEQ ID NO: 1544 - DNA, 20 bp, Artificial sequence
  Synthetic oligonucleotide
gagaaatagctacaggaatg

SEQ ID NO: 1545 - DNA, 20 bp, Artificial sequence
  Synthetic oligonucleotide
accctgagaaatagctacag

SEQ ID NO: 1546 - DNA, 20 bp, Artificial sequence
  Synthetic oligonucleotide
cacaaaccctgagaaatagc

SEQ ID NO: 1547 - DNA, 20 bp, Artificial sequence
  Synthetic oligonucleotide
aagactgggcttaggctaag

SEQ ID NO: 1548 - DNA, 20 bp, Artificial sequence
  Synthetic oligonucleotide
tcaggaaaaggagaaggaac

SEQ ID NO: 1549 - DNA, 20 bp, Artificial sequence
  Synthetic oligonucleotide
agcttcaaattttctgcagt

SEQ ID NO: 1550 - DNA, 20 bp, Artificial sequence
  Synthetic oligonucleotide
agtttctttacctccaaaat

SEQ ID NO: 1551 - DNA, 20 bp, Artificial sequence
  Synthetic oligonucleotide
atgcagcctggacaagtcct

SEQ ID NO: 1552 - DNA, 20 bp, Artificial sequence
  Synthetic oligonucleotide
agactatgcagcctggacaa

SEQ ID NO: 1553 - DNA, 20 bp, Artificial sequence
  Synthetic oligonucleotide
atactagactatgcagcctg

SEQ ID NO: 1554 - DNA, 20 bp, Artificial sequence
  Synthetic oligonucleotide
ccatcatactagactatgca

SEQ ID NO: 1555 - DNA, 20 bp, Artificial sequence
  Synthetic oligonucleotide
tgttgccatcatactagact

SEQ ID NO: 1556 - DNA, 20 bp, Artificial sequence
  Synthetic oligonucleotide
tgcaatgttgccatcatact

SEQ ID NO: 1557 - DNA, 20 bp, Artificial sequence
  Synthetic oligonucleotide
gtggttgcaatgttgccatc

SEQ ID NO: 1558 - DNA, 20 bp, Artificial sequence
  Synthetic oligonucleotide
ggatggtggttgcaatgttg

SEQ ID NO: 1559 - DNA, 20 bp, Artificial sequence
  Synthetic oligonucleotide
agcctggatggtggttgcaa

SEQ ID NO: 1560 - DNA, 20 bp, Artificial sequence
  Synthetic oligonucleotide
caataagcctggatggtggt

SEQ ID NO: 1561 - DNA, 20 bp, Artificial sequence
  Synthetic oligonucleotide
gaattcaataagcctggatg

SEQ ID NO: 1562 - DNA, 20 bp, Artificial sequence
  Synthetic oligonucleotide
tcagtggaaaagaacctggg

SEQ ID NO: 1563 - DNA, 20 bp, Artificial sequence
  Synthetic oligonucleotide
ggaaatcagtggaaaagaac

SEQ ID NO: 1564 - DNA, 20 bp, Artificial sequence
  Synthetic oligonucleotide
cagtaggaaatcagtggaaa

SEQ ID NO: 1565 - DNA, 20 bp, Artificial sequence
  Synthetic oligonucleotide
acaggcagtaggaaatcagt

SEQ ID NO: 1566 - DNA, 20 bp, Artificial sequence
  Synthetic oligonucleotide
gagaaacaggcagtaggaaa

SEQ ID NO: 1567 - DNA, 20 bp, Artificial sequence
  Synthetic oligonucleotide
gacccaggaagctggaatca

SEQ ID NO: 1568 - DNA, 20 bp, Artificial sequence
  Synthetic oligonucleotide
agggagacccaggaagctgg

SEQ ID NO: 1569 - DNA, 20 bp, Artificial sequence
  Synthetic oligonucleotide
actgagatctccagcagcaa

SEQ ID NO: 1570 - DNA, 20 bp, Artificial sequence
  Synthetic oligonucleotide
aatggagtgacagggcagga

SEQ ID NO: 1571 - DNA, 20 bp, Artificial sequence
  Synthetic oligonucleotide
agggagcaatggtggcaggt

SEQ ID NO: 1572 - DNA, 20 bp, Artificial sequence
  Synthetic oligonucleotide
tggacagggagcaatggtgg

SEQ ID NO: 1573 - DNA, 20 bp, Artificial sequence
  Synthetic oligonucleotide
tgcactggacagggagcaat

SEQ ID NO: 1574 - DNA, 20 bp, Artificial sequence
  Synthetic oligonucleotide
agccctgcactggacaggga

SEQ ID NO: 1575 - DNA, 20 bp, Artificial sequence
  Synthetic oligonucleotide
ttgtgtccccatgcccagca

SEQ ID NO: 1576 - DNA, 20 bp, Artificial sequence
  Synthetic oligonucleotide
ctgacttgtgtccccatgcc

SEQ ID NO: 1577 - DNA, 20 bp, Artificial sequence
  Synthetic oligonucleotide
cagggctgacttgtgtcccc

SEQ ID NO: 1578 - DNA, 20 bp, Artificial sequence
  Synthetic oligonucleotide
acaaagtctatcaggatgca

SEQ ID NO: 1579 - DNA, 20 bp, Artificial sequence
  Synthetic oligonucleotide
aagtgacaaagtctatcagg

SEQ ID NO: 1580 - DNA, 20 bp, Artificial sequence
  Synthetic oligonucleotide
gtctgcccatggccccatgg

SEQ ID NO: 1581 - DNA, 20 bp, Artificial sequence
  Synthetic oligonucleotide
agaaagtctgcccatggccc

SEQ ID NO: 1582 - DNA, 20 bp, Artificial sequence
  Synthetic oligonucleotide
gcttgagaaagtctgcccat

SEQ ID NO: 1583 - DNA, 20 bp, Artificial sequence
  Synthetic oligonucleotide
agcaggcttgagaaagtctg

SEQ ID NO: 1584 - DNA, 20 bp, Artificial sequence
  Synthetic oligonucleotide
ggctcagcaggcttgagaaa

SEQ ID NO: 1585 - DNA, 20 bp, Artificial sequence
  Synthetic oligonucleotide
gatgaggctcagcaggcttg

SEQ ID NO: 1586 - DNA, 20 bp, Artificial sequence
  Synthetic oligonucleotide
ttgcagatgaggctcagcag

SEQ ID NO: 1587 - DNA, 20 bp, Artificial sequence
  Synthetic oligonucleotide
ccattttgcagatgaggctc

SEQ ID NO: 1588 - DNA, 20 bp, Artificial sequence
  Synthetic oligonucleotide
cagctccattttgcagatga

SEQ ID NO: 1589 - DNA, 20 bp, Artificial sequence
  Synthetic oligonucleotide
agaacagtctatcatcactc

SEQ ID NO: 1590 - DNA, 20 bp, Artificial sequence
  Synthetic oligonucleotide
gaggtgagagagaaagcaga

SEQ ID NO: 1591 - DNA, 20 bp, Artificial sequence
  Synthetic oligonucleotide
cccctgaggtgagagagaaa

SEQ ID NO: 1592 - DNA, 20 bp, Artificial sequence
  Synthetic oligonucleotide
cctggcccctgaggtgagag

SEQ ID NO: 1593 - DNA, 20 bp, Artificial sequence
  Synthetic oligonucleotide
tggagcctggcccctgaggt

SEQ ID NO: 1594 - DNA, 20 bp, Artificial sequence
  Synthetic oligonucleotide
aacactggagcctggcccct

SEQ ID NO: 1595 - DNA, 20 bp, Artificial sequence
  Synthetic oligonucleotide
cagagaacactggagcctgg

SEQ ID NO: 1596 - DNA, 20 bp, Artificial sequence
  Synthetic oligonucleotide
ggcaacagagaacactggag

SEQ ID NO: 1597 - DNA, 20 bp, Artificial sequence
  Synthetic oligonucleotide
acagtggcaacagagaacac

SEQ ID NO: 1598 - DNA, 20 bp, Artificial sequence
  Synthetic oligonucleotide
caggccacagtggcaacaga

SEQ ID NO: 1599 - DNA, 20 bp, Artificial sequence
  Synthetic oligonucleotide
aggaccaggccacagtggca

SEQ ID NO: 1600 - DNA, 20 bp, Artificial sequence
  Synthetic oligonucleotide
tccagaggaccaggccacag

SEQ ID NO: 1601 - DNA, 20 bp, Artificial sequence
  Synthetic oligonucleotide
gggctactggcctcctggag

SEQ ID NO: 1602 - DNA, 20 bp, Artificial sequence
  Synthetic oligonucleotide
caaaggacacctgcctgtcc

SEQ ID NO: 1603 - DNA, 20 bp, Artificial sequence
  Synthetic oligonucleotide
gatagcaaaggacacctgcc

SEQ ID NO: 1604 - DNA, 20 bp, Artificial sequence
  Synthetic oligonucleotide
tcttttggaagggtggagat

SEQ ID NO: 1605 - DNA, 20 bp, Artificial sequence
  Synthetic oligonucleotide
ttggttcttttggaagggtg

SEQ ID NO: 1606 - DNA, 20 bp, Artificial sequence
  Synthetic oligonucleotide
gatgtgagaaggacacaggg

SEQ ID NO: 1607 - DNA, 20 bp, Artificial sequence
  Synthetic oligonucleotide
acagagatgtgagaaggaca

SEQ ID NO: 1608 - DNA, 20 bp, Artificial sequence
  Synthetic oligonucleotide
ttggaacagagatgtgagaa

SEQ ID NO: 1609 - DNA, 20 bp, Artificial sequence
  Synthetic oligonucleotide
acttcttggaacagagatgt

SEQ ID NO: 1610 - DNA, 20 bp, Artificial sequence
  Synthetic oligonucleotide
gccctcacagggccaggttg

SEQ ID NO: 1611 - DNA, 20 bp, Artificial sequence
  Synthetic oligonucleotide
ccccagggagccctcacagg

SEQ ID NO: 1612 - DNA, 20 bp, Artificial sequence
  Synthetic oligonucleotide
tagtgccccagggagccctc

SEQ ID NO: 1613 - DNA, 20 bp, Artificial sequence
  Synthetic oligonucleotide
tgtcctagtgccccagggag

SEQ ID NO: 1614 - DNA, 20 bp, Artificial sequence
  Synthetic oligonucleotide
tcaacaccccagcctgcctc

SEQ ID NO: 1615 - DNA, 20 bp, Artificial sequence
  Synthetic oligonucleotide
gaggctcaacaccccagcct

SEQ ID NO: 1616 - DNA, 20 bp, Artificial sequence
  Synthetic oligonucleotide
aggagggtcacacacacccc

SEQ ID NO: 1617 - DNA, 20 bp, Artificial sequence
  Synthetic oligonucleotide
gcaagaggccaggaaaaggg

SEQ ID NO: 1618 - DNA, 20 bp, Artificial sequence
  Synthetic oligonucleotide
tactggcaagaggccaggaa

SEQ ID NO: 1619 - DNA, 20 bp, Artificial sequence
  Synthetic oligonucleotide
atgattactggcaagaggcc

SEQ ID NO: 1620 - DNA, 20 bp, Artificial sequence
  Synthetic oligonucleotide
attacatgattactggcaag

SEQ ID NO: 1621 - DNA, 20 bp, Artificial sequence
  Synthetic oligonucleotide
aaaatatacatgctcttttt

SEQ ID NO: 1622 - DNA, 20 bp, Artificial sequence
  Synthetic oligonucleotide
actcaaaaatatacatgctc

SEQ ID NO: 1623 - DNA, 20 bp, Artificial sequence
  Synthetic oligonucleotide
tttctactcaaaaatataca

SEQ ID NO: 1624 - DNA, 20 bp, Artificial sequence
  Synthetic oligonucleotide
tcctttttctactcaaaaat

SEQ ID NO: 1625 - DNA, 20 bp, Artificial sequence
  Synthetic oligonucleotide
ttctgattagaaaaataata

SEQ ID NO: 1626 - DNA, 20 bp, Artificial sequence
  Synthetic oligonucleotide
ttttattctgattagaaaaa

SEQ ID NO: 1627 - DNA, 20 bp, Artificial sequence
  Synthetic oligonucleotide
tattctgctcataaaaacat

SEQ ID NO: 1628 - DNA, 20 bp, Artificial sequence
  Synthetic oligonucleotide
aagggtattctgctcataaa

SEQ ID NO: 1629 - DNA, 20 bp, Artificial sequence
  Synthetic oligonucleotide
tgagtaagggtattctgctc

SEQ ID NO: 1630 - DNA, 20 bp, Artificial sequence
  Synthetic oligonucleotide
gacaatgagtaagggtattc

SEQ ID NO: 1631 - DNA, 20 bp, Artificial sequence
  Synthetic oligonucleotide
agagagacaatgagtaaggg

SEQ ID NO: 1632 - DNA, 20 bp, Artificial sequence
  Synthetic oligonucleotide
ggctgagagagacaatgagt

SEQ ID NO: 1633 - DNA, 20 bp, Artificial sequence
  Synthetic oligonucleotide
agcctgtgacacctaccctg

SEQ ID NO: 1634 - DNA, 20 bp, Artificial sequence
  Synthetic oligonucleotide
atgcagtgtccctaaaccct

SEQ ID NO: 1635 - DNA, 20 bp, Artificial sequence
  Synthetic oligonucleotide
gggtgatgcagtgtccctaa

SEQ ID NO: 1636 - DNA, 20 bp, Artificial sequence
  Synthetic oligonucleotide
tggcttcctcagggcccacc

SEQ ID NO: 1637 - DNA, 20 bp, Artificial sequence
  Synthetic oligonucleotide
cctgacctgtggtactaagg

SEQ ID NO: 1638 - DNA, 20 bp, Artificial sequence
  Synthetic oligonucleotide
agccctgtgccagccagcct

SEQ ID NO: 1639 - DNA, 20 bp, Artificial sequence
  Synthetic oligonucleotide
gcgacagccctgtgccagcc

SEQ ID NO: 1640 - DNA, 20 bp, Artificial sequence
  Synthetic oligonucleotide
gacaagcgacagccctgtgc

SEQ ID NO: 1641 - DNA, 20 bp, Artificial sequence
  Synthetic oligonucleotide
ccacagtcagctgggctcag

SEQ ID NO: 1642 - DNA, 20 bp, Artificial sequence
  Synthetic oligonucleotide
ctttcccacagtcagctggg

SEQ ID NO: 1643 - DNA, 20 bp, Artificial sequence
  Synthetic oligonucleotide
ggaaactttcccacagtcag

SEQ ID NO: 1644 - DNA, 20 bp, Artificial sequence
  Synthetic oligonucleotide
caaatggaaactttcccaca

SEQ ID NO: 1645 - DNA, 20 bp, Artificial sequence
  Synthetic oligonucleotide
ggcctggaaaagggacactg

SEQ ID NO: 1646 - DNA, 20 bp, Artificial sequence
  Synthetic oligonucleotide
cccctggcctggaaaaggga

SEQ ID NO: 1647 - DNA, 20 bp, Artificial sequence
  Synthetic oligonucleotide
ctactcccctggcctggaaa

SEQ ID NO: 1648 - DNA, 20 bp, Artificial sequence
  Synthetic oligonucleotide
acctcctactcccctggcct

SEQ ID NO: 1649 - DNA, 20 bp, Artificial sequence
  Synthetic oligonucleotide
agcccacctcctactcccct

SEQ ID NO: 1650 - DNA, 20 bp, Artificial sequence
  Synthetic oligonucleotide
caggcagcccacctcctact

SEQ ID NO: 1651 - DNA, 20 bp, Artificial sequence
  Synthetic oligonucleotide
tgagacaggcagcccacctc

SEQ ID NO: 1652 - DNA, 20 bp, Artificial sequence
  Synthetic oligonucleotide
cagaatgagacaggcagccc

SEQ ID NO: 1653 - DNA, 20 bp, Artificial sequence
  Synthetic oligonucleotide
ctctgtgggctcctccacag

SEQ ID NO: 1654 - DNA, 20 bp, Artificial sequence
  Synthetic oligonucleotide
ctgtgctctgtgggctcctc

SEQ ID NO: 1655 - DNA, 20 bp, Artificial sequence
  Synthetic oligonucleotide
tggccctgtgctctgtgggc

SEQ ID NO: 1656 - DNA, 20 bp, Artificial sequence
  Synthetic oligonucleotide
ttacttggccctgtgctctg

SEQ ID NO: 1657 - DNA, 20 bp, Artificial sequence
  Synthetic oligonucleotide
actgtcagtctctccaaact

SEQ ID NO: 1658 - DNA, 20 bp, Artificial sequence
  Synthetic oligonucleotide
cccccactgtcagtctctcc

SEQ ID NO: 1659 - DNA, 20 bp, Artificial sequence
  Synthetic oligonucleotide
ctctgcccccactgtcagtc

SEQ ID NO: 1660 - DNA, 20 bp, Artificial sequence
  Synthetic oligonucleotide
gcaagctctgcccccactgt

SEQ ID NO: 1661 - DNA, 20 bp, Artificial sequence
  Synthetic oligonucleotide
tggctgcaagctctgccccc

SEQ ID NO: 1662 - DNA, 20 bp, Artificial sequence
  Synthetic oligonucleotide
ggccttggctgcaagctctg

SEQ ID NO: 1663 - DNA, 20 bp, Artificial sequence
  Synthetic oligonucleotide
aatccaacccttgtcactct

SEQ ID NO: 1664 - DNA, 20 bp, Artificial sequence
  Synthetic oligonucleotide
actcaaatccaacccttgtc

SEQ ID NO: 1665 - DNA, 20 bp, Artificial sequence
  Synthetic oligonucleotide
tattctaaaactcaaatcca

SEQ ID NO: 1666 - DNA, 20 bp, Artificial sequence
  Synthetic oligonucleotide
gtgattattctaaaactcaa

SEQ ID NO: 1667 - DNA, 20 bp, Artificial sequence
  Synthetic oligonucleotide
ccagagtgattattctaaaa

SEQ ID NO: 1668 - DNA, 20 bp, Artificial sequence
  Synthetic oligonucleotide
cctccctctgggcccatcct

SEQ ID NO: 1669 - DNA, 20 bp, Artificial sequence
  Synthetic oligonucleotide
tttgcactctgccagcctcc

SEQ ID NO: 1670 - DNA, 20 bp, Artificial sequence
  Synthetic oligonucleotide
tcttctttgcactctgccag

SEQ ID NO: 1671 - DNA, 20 bp, Artificial sequence
  Synthetic oligonucleotide
tgcccttgttcctctcagtc

SEQ ID NO: 1672 - DNA, 20 bp, Artificial sequence
  Synthetic oligonucleotide
atgtttgcccttgttcctct

SEQ ID NO: 1673 - DNA, 20 bp, Artificial sequence
  Synthetic oligonucleotide
gttgggcagtcaccatttgc

SEQ ID NO: 1674 - DNA, 20 bp, Artificial sequence
  Synthetic oligonucleotide
ctggtgttgggcagtcacca

SEQ ID NO: 1675 - DNA, 20 bp, Artificial sequence
  Synthetic oligonucleotide
cagtgctggtgttgggcagt

SEQ ID NO: 1676 - DNA, 20 bp, Artificial sequence
  Synthetic oligonucleotide
cagactctcatccccagggc

SEQ ID NO: 1677 - DNA, 20 bp, Artificial sequence
  Synthetic oligonucleotide
ggatgtgtcatttcccctgg

SEQ ID NO: 1678 - DNA, 20 bp, Artificial sequence
  Synthetic oligonucleotide
aggaaactggctgggagagg

SEQ ID NO: 1679 - DNA, 20 bp, Artificial sequence
  Synthetic oligonucleotide
gtcagaggaaactggctggg

SEQ ID NO: 1680 - DNA, 20 bp, Artificial sequence
  Synthetic oligonucleotide
cttgggtcagaggaaactgg

SEQ ID NO: 1681 - DNA, 20 bp, Artificial sequence
  Synthetic oligonucleotide
atgaccttgggtcagaggaa

SEQ ID NO: 1682 - DNA, 20 bp, Artificial sequence
  Synthetic oligonucleotide
caaggatgaccttgggtcag

SEQ ID NO: 1683 - DNA, 20 bp, Artificial sequence
  Synthetic oligonucleotide
agctgcaaggatgaccttgg

SEQ ID NO: 1684 - DNA, 20 bp, Artificial sequence
  Synthetic oligonucleotide
tcaccagctgcaaggatgac

SEQ ID NO: 1685 - DNA, 20 bp, Artificial sequence
  Synthetic oligonucleotide
aacagtgcccagcaggagca

SEQ ID NO: 1686 - DNA, 20 bp, Artificial sequence
  Synthetic oligonucleotide
ttgacaacagtgcccagcag

SEQ ID NO: 1687 - DNA, 20 bp, Artificial sequence
  Synthetic oligonucleotide
aggccttgacaacagtgccc

SEQ ID NO: 1688 - DNA, 20 bp, Artificial sequence
  Synthetic oligonucleotide
ggctcaggccttgacaacag

SEQ ID NO: 1689 - DNA, 20 bp, Artificial sequence
  Synthetic oligonucleotide
ggagaggctcaggccttgac

SEQ ID NO: 1690 - DNA, 20 bp, Artificial sequence
  Synthetic oligonucleotide
ggctccctgtgtcaccctgc

SEQ ID NO: 1691 - DNA, 20 bp, Artificial sequence
  Synthetic oligonucleotide
gtgttggctccctgtgtcac

SEQ ID NO: 1692 - DNA, 20 bp, Artificial sequence
  Synthetic oligonucleotide
atggtgtgttggctccctgt

SEQ ID NO: 1693 - DNA, 20 bp, Artificial sequence
  Synthetic oligonucleotide
aaggaatggtgtgttggctc

SEQ ID NO: 1694 - DNA, 20 bp, Artificial sequence
  Synthetic oligonucleotide
gcaccaaggaatggtgtgtt

SEQ ID NO: 1695 - DNA, 20 bp, Artificial sequence
  Synthetic oligonucleotide
gcccagcaccaaggaatggt

SEQ ID NO: 1696 - DNA, 20 bp, Artificial sequence
  Synthetic oligonucleotide
tgcaggcccagcaccaagga

SEQ ID NO: 1697 - DNA, 20 bp, Artificial sequence
  Synthetic oligonucleotide
cccaatgcaggcccagcacc

SEQ ID NO: 1698 - DNA, 20 bp, Artificial sequence
  Synthetic oligonucleotide
agggccctttccagaaaatc

SEQ ID NO: 1699 - DNA, 20 bp, Artificial sequence
  Synthetic oligonucleotide
cagggccctttccagaaaat

SEQ ID NO: 1700 - DNA, 20 bp, Artificial sequence
  Synthetic oligonucleotide
acagggccctttccagaaaa

SEQ ID NO: 1701 - DNA, 20 bp, Artificial sequence
  Synthetic oligonucleotide
cacagggccctttccagaaa

SEQ ID NO: 1702 - DNA, 20 bp, Artificial sequence
  Synthetic oligonucleotide
gccacagggccctttccaga

SEQ ID NO: 1703 - DNA, 20 bp, Artificial sequence
  Synthetic oligonucleotide
tgccacagggccctttccag

SEQ ID NO: 1704 - DNA, 20 bp, Artificial sequence
  Synthetic oligonucleotide
ctgccacagggccctttcca

SEQ ID NO: 1705 - DNA, 20 bp, Artificial sequence
  Synthetic oligonucleotide
cctgccacagggccctttcc

SEQ ID NO: 1706 - DNA, 20 bp, Artificial sequence
  Synthetic oligonucleotide
gaatatccctaataactaag

SEQ ID NO: 1707 - DNA, 20 bp, Artificial sequence
  Synthetic oligonucleotide
cgaatatccctaataactaa

SEQ ID NO: 1708 - DNA, 20 bp, Artificial sequence
  Synthetic oligonucleotide
tcgaatatccctaataacta

SEQ ID NO: 1709 - DNA, 20 bp, Artificial sequence
  Synthetic oligonucleotide
ctcgaatatccctaataact

SEQ ID NO: 1710 - DNA, 20 bp, Artificial sequence
  Synthetic oligonucleotide
ttctcgaatatccctaataa

SEQ ID NO: 1711 - DNA, 20 bp, Artificial sequence
  Synthetic oligonucleotide
gttctcgaatatccctaata

SEQ ID NO: 1712 - DNA, 20 bp, Artificial sequence
  Synthetic oligonucleotide
agttctcgaatatccctaat

SEQ ID NO: 1713 - DNA, 20 bp, Artificial sequence
  Synthetic oligonucleotide
gagttctcgaatatccctaa

SEQ ID NO: 1714 - DNA, 20 bp, Artificial sequence
  Synthetic oligonucleotide
aggagttctcgaatatccct

SEQ ID NO: 1715 - DNA, 20 bp, Artificial sequence
  Synthetic oligonucleotide
gaggagttctcgaatatccc

SEQ ID NO: 1716 - DNA, 20 bp, Artificial sequence
  Synthetic oligonucleotide
ggaggagttctcgaatatcc

SEQ ID NO: 1717 - DNA, 20 bp, Artificial sequence
  Synthetic oligonucleotide
gggaggagttctcgaatatc

SEQ ID NO: 1718 - DNA, 20 bp, Artificial sequence
  Synthetic oligonucleotide
gcagggtcctctccgctgcc

SEQ ID NO: 1719 - DNA, 20 bp, Artificial sequence
  Synthetic oligonucleotide
tgcagggtcctctccgctgc

SEQ ID NO: 1720 - DNA, 20 bp, Artificial sequence
  Synthetic oligonucleotide
gattcactgaggacctcagt

SEQ ID NO: 1721 - DNA, 20 bp, Artificial sequence
  Synthetic oligonucleotide
cgattcactgaggacctcag

SEQ ID NO: 1722 - DNA, 20 bp, Artificial sequence
  Synthetic oligonucleotide
gcgattcactgaggacctca

SEQ ID NO: 1723 - DNA, 20 bp, Artificial sequence
  Synthetic oligonucleotide
cgcgattcactgaggacctc

SEQ ID NO: 1724 - DNA, 20 bp, Artificial sequence
  Synthetic oligonucleotide
tgcgcgattcactgaggacc

SEQ ID NO: 1725 - DNA, 20 bp, Artificial sequence
  Synthetic oligonucleotide
ctgcgcgattcactgaggac

SEQ ID NO: 1726 - DNA, 20 bp, Artificial sequence
  Synthetic oligonucleotide
tctgcgcgattcactgagga

SEQ ID NO: 1727 - DNA, 20 bp, Artificial sequence
  Synthetic oligonucleotide
ctctgcgcgattcactgagg

SEQ ID NO: 1728 - DNA, 20 bp, Artificial sequence
  Synthetic oligonucleotide
cctcccacttcagtttctcc

SEQ ID NO: 1729 - DNA, 20 bp, Artificial sequence
  Synthetic oligonucleotide
tcctcccacttcagtttctc

SEQ ID NO: 1730 - DNA, 20 bp, Artificial sequence
  Synthetic oligonucleotide
ttcctcccacttcagtttct

SEQ ID NO: 1731 - DNA, 20 bp, Artificial sequence
  Synthetic oligonucleotide
cttcctcccacttcagtttc

SEQ ID NO: 1732 - DNA, 20 bp, Artificial sequence
  Synthetic oligonucleotide
tgcttcctcccacttcagtt

SEQ ID NO: 1733 - DNA, 20 bp, Artificial sequence
  Synthetic oligonucleotide
atgcttcctcccacttcagt

SEQ ID NO: 1734 - DNA, 20 bp, Artificial sequence
  Synthetic oligonucleotide
catgcttcctcccacttcag

SEQ ID NO: 1735 - DNA, 20 bp, Artificial sequence
  Synthetic oligonucleotide
gcatgcttcctcccacttca

SEQ ID NO: 1736 - DNA, 20 bp, Artificial sequence
  Synthetic oligonucleotide
aggcatgcttcctcccactt

SEQ ID NO: 1737 - DNA, 20 bp, Artificial sequence
  Synthetic oligonucleotide
taggcatgcttcctcccact

SEQ ID NO: 1738 - DNA, 20 bp, Artificial sequence
  Synthetic oligonucleotide
ttaggcatgcttcctcccac

SEQ ID NO: 1739 - DNA, 20 bp, Artificial sequence
  Synthetic oligonucleotide
cttaggcatgcttcctccca

SEQ ID NO: 1740 - DNA, 20 bp, Artificial sequence
  Synthetic oligonucleotide
aacttaggcatgcttcctcc

SEQ ID NO: 1741 - DNA, 20 bp, Artificial sequence
  Synthetic oligonucleotide
aaacttaggcatgcttcctc

SEQ ID NO: 1742 - DNA, 20 bp, Artificial sequence
  Synthetic oligonucleotide
aaaacttaggcatgcttcct

SEQ ID NO: 1743 - DNA, 20 bp, Artificial sequence
  Synthetic oligonucleotide
gaaaacttaggcatgcttcc

SEQ ID NO: 1744 - DNA, 20 bp, Artificial sequence
  Synthetic oligonucleotide
aggaaaacttaggcatgctt

SEQ ID NO: 1745 - DNA, 20 bp, Artificial sequence
  Synthetic oligonucleotide
aaggaaaacttaggcatgct

SEQ ID NO: 1746 - DNA, 20 bp, Artificial sequence
  Synthetic oligonucleotide
taaggaaaacttaggcatgc

SEQ ID NO: 1747 - DNA, 20 bp, Artificial sequence
  Synthetic oligonucleotide
ctaaggaaaacttaggcatg

SEQ ID NO: 1748 - DNA, 20 bp, Artificial sequence
  Synthetic oligonucleotide
agctaaggaaaacttaggca

SEQ ID NO: 1749 - DNA, 20 bp, Artificial sequence
  Synthetic oligonucleotide
cagctaaggaaaacttaggc

SEQ ID NO: 1750 - DNA, 20 bp, Artificial sequence
  Synthetic oligonucleotide
tcagctaaggaaaacttagg

SEQ ID NO: 1751 - DNA, 20 bp, Artificial sequence
  Synthetic oligonucleotide
atcagctaaggaaaacttag

SEQ ID NO: 1752 - DNA, 20 bp, Artificial sequence
  Synthetic oligonucleotide
tgtgatgacttcccagggtc

SEQ ID NO: 1753 - DNA, 20 bp, Artificial sequence
  Synthetic oligonucleotide
ctgtgatgacttcccagggt

SEQ ID NO: 1754 - DNA, 20 bp, Artificial sequence
  Synthetic oligonucleotide
gctgtgatgacttcccaggg

SEQ ID NO: 1755 - DNA, 20 bp, Artificial sequence
  Synthetic oligonucleotide
agctgtgatgacttcccagg

SEQ ID NO: 1756 - DNA, 20 bp, Artificial sequence
  Synthetic oligonucleotide
acagctgtgatgacttccca

SEQ ID NO: 1757 - DNA, 20 bp, Artificial sequence
  Synthetic oligonucleotide
gacagctgtgatgacttccc

SEQ ID NO: 1758 - DNA, 20 bp, Artificial sequence
  Synthetic oligonucleotide
ggacagctgtgatgacttcc

SEQ ID NO: 1759 - DNA, 20 bp, Artificial sequence
  Synthetic oligonucleotide
aggacagctgtgatgacttc

SEQ ID NO: 1760 - DNA, 20 bp, Artificial sequence
  Synthetic oligonucleotide
catgtcagagaggctcagca

SEQ ID NO: 1761 - DNA, 20 bp, Artificial sequence
  Synthetic oligonucleotide
ccatgtcagagaggctcagc

SEQ ID NO: 1762 - DNA, 20 bp, Artificial sequence
  Synthetic oligonucleotide
tccatgtcagagaggctcag

SEQ ID NO: 1763 - DNA, 20 bp, Artificial sequence
  Synthetic oligonucleotide
atccatgtcagagaggctca

SEQ ID NO: 1764 - DNA, 20 bp, Artificial sequence
  Synthetic oligonucleotide
aaatccatgtcagagaggct

SEQ ID NO: 1765 - DNA, 20 bp, Artificial sequence
  Synthetic oligonucleotide
aaaatccatgtcagagaggc

SEQ ID NO: 1766 - DNA, 20 bp, Artificial sequence
  Synthetic oligonucleotide
aaaaatccatgtcagagagg

SEQ ID NO: 1767 - DNA, 20 bp, Artificial sequence
  Synthetic oligonucleotide
gaaaaatccatgtcagagag

SEQ ID NO: 1768 - DNA, 20 bp, Artificial sequence
  Synthetic oligonucleotide
tggatagtcgatttaccaga

SEQ ID NO: 1769 - DNA, 20 bp, Artificial sequence
  Synthetic oligonucleotide
ttggatagtcgatttaccag

SEQ ID NO: 1770 - DNA, 20 bp, Artificial sequence
  Synthetic oligonucleotide
ctttggatagtcgatttacc

SEQ ID NO: 1771 - DNA, 20 bp, Artificial sequence
  Synthetic oligonucleotide
acctcgatgttacattaagg

SEQ ID NO: 1772 - DNA, 20 bp, Artificial sequence
  Synthetic oligonucleotide
aacctcgatgttacattaag

SEQ ID NO: 1773 - DNA, 20 bp, Artificial sequence
  Synthetic oligonucleotide
aaacctcgatgttacattaa

SEQ ID NO: 1774 - DNA, 20 bp, Artificial sequence
  Synthetic oligonucleotide
gaaacctcgatgttacatta

SEQ ID NO: 1775 - DNA, 20 bp, Artificial sequence
  Synthetic oligonucleotide
tattgcaaccactaggacat

SEQ ID NO: 1776 - DNA, 20 bp, Artificial sequence
  Synthetic oligonucleotide
ttattgcaaccactaggaca

SEQ ID NO: 1777 - DNA, 20 bp, Artificial sequence
  Synthetic oligonucleotide
gttattgcaaccactaggac

SEQ ID NO: 1778 - DNA, 20 bp, Artificial sequence
  Synthetic oligonucleotide
ggttattgcaaccactagga

SEQ ID NO: 1779 - DNA, 20 bp, Artificial sequence
  Synthetic oligonucleotide
tgggttattgcaaccactag

SEQ ID NO: 1780 - DNA, 20 bp, Artificial sequence
  Synthetic oligonucleotide
gtgggttattgcaaccacta

SEQ ID NO: 1781 - DNA, 20 bp, Artificial sequence
  Synthetic oligonucleotide
ggtgggttattgcaaccact

SEQ ID NO: 1782 - DNA, 20 bp, Artificial sequence
  Synthetic oligonucleotide
tcacagttaaagtgtggtac

SEQ ID NO: 1783 - DNA, 20 bp, Artificial sequence
  Synthetic oligonucleotide
gtcacagttaaagtgtggta

SEQ ID NO: 1784 - DNA, 20 bp, Artificial sequence
  Synthetic oligonucleotide
ggtcacagttaaagtgtggt

SEQ ID NO: 1785 - DNA, 20 bp, Artificial sequence
  Synthetic oligonucleotide
aggtcacagttaaagtgtgg

SEQ ID NO: 1786 - DNA, 20 bp, Artificial sequence
  Synthetic oligonucleotide
aatgcctaggtcacagttaa

SEQ ID NO: 1787 - DNA, 20 bp, Artificial sequence
  Synthetic oligonucleotide
caatgcctaggtcacagtta

SEQ ID NO: 1788 - DNA, 20 bp, Artificial sequence
  Synthetic oligonucleotide
ccaatgcctaggtcacagtt

SEQ ID NO: 1789 - DNA, 20 bp, Artificial sequence
  Synthetic oligonucleotide
gccaatgcctaggtcacagt

SEQ ID NO: 1790 - DNA, 20 bp, Artificial sequence
  Synthetic oligonucleotide
atgccaatgcctaggtcaca

SEQ ID NO: 1791 - DNA, 20 bp, Artificial sequence
  Synthetic oligonucleotide
aatgccaatgcctaggtcac

SEQ ID NO: 1792 - DNA, 20 bp, Artificial sequence
  Synthetic oligonucleotide
caatgccaatgcctaggtca

SEQ ID NO: 1793 - DNA, 20 bp, Artificial sequence
  Synthetic oligonucleotide
gcaatgccaatgcctaggtc

SEQ ID NO: 1794 - DNA, 20 bp, Artificial sequence
  Synthetic oligonucleotide
ccacagcgataatcacacaa

SEQ ID NO: 1795 - DNA, 20 bp, Artificial sequence
  Synthetic oligonucleotide
accacagcgataatcacaca

SEQ ID NO: 1796 - DNA, 20 bp, Artificial sequence
  Synthetic oligonucleotide
aaccacagcgataatcacac

SEQ ID NO: 1797 - DNA, 20 bp, Artificial sequence
  Synthetic oligonucleotide
taaccacagcgataatcaca

SEQ ID NO: 1798 - DNA, 20 bp, Artificial sequence
  Synthetic oligonucleotide
gcagggtctgccactctcta

SEQ ID NO: 1799 - DNA, 20 bp, Artificial sequence
  Synthetic oligonucleotide
agcagggtctgccactctct

SEQ ID NO: 1800 - DNA, 20 bp, Artificial sequence
  Synthetic oligonucleotide
gagcagggtctgccactctc

SEQ ID NO: 1801 - DNA, 20 bp, Artificial sequence
  Synthetic oligonucleotide
agagcagggtctgccactct

SEQ ID NO: 1802 - DNA, 20 bp, Artificial sequence
  Synthetic oligonucleotide
gcacagtcatcttgtgtaca

SEQ ID NO: 1803 - DNA, 20 bp, Artificial sequence
  Synthetic oligonucleotide
tgcacagtcatcttgtgtac

SEQ ID NO: 1804 - DNA, 20 bp, Artificial sequence
  Synthetic oligonucleotide
ctgcacagtcatcttgtgta

SEQ ID NO: 1805 - DNA, 20 bp, Artificial sequence
  Synthetic oligonucleotide
tctgcacagtcatcttgtgt

SEQ ID NO: 1806 - DNA, 20 bp, Artificial sequence
  Synthetic oligonucleotide
agatcactctgcacagtcat

SEQ ID NO: 1807 - DNA, 20 bp, Artificial sequence
  Synthetic oligonucleotide
cagatcactctgcacagtca

SEQ ID NO: 1808 - DNA, 20 bp, Artificial sequence
  Synthetic oligonucleotide
tcagatcactctgcacagtc

SEQ ID NO: 1809 - DNA, 20 bp, Artificial sequence
  Synthetic oligonucleotide
ctcagatcactctgcacagt

SEQ ID NO: 1810 - DNA, 20 bp, Artificial sequence
  Synthetic oligonucleotide
tgctcagatcactctgcaca

SEQ ID NO: 1811 - DNA, 20 bp, Artificial sequence
  Synthetic oligonucleotide
ttgctcagatcactctgcac

SEQ ID NO: 1812 - DNA, 20 bp, Artificial sequence
  Synthetic oligonucleotide
attgctcagatcactctgca

SEQ ID NO: 1813 - DNA, 20 bp, Artificial sequence
  Synthetic oligonucleotide
cattgctcagatcactctgc

SEQ ID NO: 1814 - DNA, 20 bp, Artificial sequence
  Synthetic oligonucleotide
cctcttccaggaagacttcc

SEQ ID NO: 1815 - DNA, 20 bp, Artificial sequence
  Synthetic oligonucleotide
acctcttccaggaagacttc

SEQ ID NO: 1816 - DNA, 20 bp, Artificial sequence
  Synthetic oligonucleotide
cacctcttccaggaagactt

SEQ ID NO: 1817 - DNA, 20 bp, Artificial sequence
  Synthetic oligonucleotide
tcacctcttccaggaagact

SEQ ID NO: 1818 - DNA, 20 bp, Artificial sequence
  Synthetic oligonucleotide
tgtcacctcttccaggaaga

SEQ ID NO: 1819 - DNA, 20 bp, Artificial sequence
  Synthetic oligonucleotide
atgtcacctcttccaggaag

SEQ ID NO: 1820 - DNA, 20 bp, Artificial sequence
  Synthetic oligonucleotide
aatgtcacctcttccaggaa

SEQ ID NO: 1821 - DNA, 20 bp, Artificial sequence
  Synthetic oligonucleotide
gaatgtcacctcttccagga

SEQ ID NO: 1822 - DNA, 20 bp, Artificial sequence
  Synthetic oligonucleotide
ctgaatgtcacctcttccag

SEQ ID NO: 1823 - DNA, 20 bp, Artificial sequence
  Synthetic oligonucleotide
actgaatgtcacctcttcca

SEQ ID NO: 1824 - DNA, 20 bp, Artificial sequence
  Synthetic oligonucleotide
gactgaatgtcacctcttcc

SEQ ID NO: 1825 - DNA, 20 bp, Artificial sequence
  Synthetic oligonucleotide
ggactgaatgtcacctcttc

SEQ ID NO: 1826 - DNA, 20 bp, Artificial sequence
  Synthetic oligonucleotide
ccggactgaatgtcacctct

SEQ ID NO: 1827 - DNA, 20 bp, Artificial sequence
  Synthetic oligonucleotide
tccggactgaatgtcacctc

SEQ ID NO: 1828 - DNA, 20 bp, Artificial sequence
  Synthetic oligonucleotide
atccggactgaatgtcacct

SEQ ID NO: 1829 - DNA, 20 bp, Artificial sequence
  Synthetic oligonucleotide
gatccggactgaatgtcacc

SEQ ID NO: 1830 - DNA, 20 bp, Artificial sequence
  Synthetic oligonucleotide
ctttccagatccggactgaa

SEQ ID NO: 1831 - DNA, 20 bp, Artificial sequence
  Synthetic oligonucleotide
tctttccagatccggactga

SEQ ID NO: 1832 - DNA, 20 bp, Artificial sequence
  Synthetic oligonucleotide
atctttccagatccggactg

SEQ ID NO: 1833 - DNA, 20 bp, Artificial sequence
  Synthetic oligonucleotide
catctttccagatccggact

SEQ ID NO: 1834 - DNA, 20 bp, Artificial sequence
  Synthetic oligonucleotide
ttcatctttccagatccgga

SEQ ID NO: 1835 - DNA, 20 bp, Artificial sequence
  Synthetic oligonucleotide
attcatctttccagatccgg

SEQ ID NO: 1836 - DNA, 20 bp, Artificial sequence
  Synthetic oligonucleotide
tattcatctttccagatccg

SEQ ID NO: 1837 - DNA, 20 bp, Artificial sequence
  Synthetic oligonucleotide
ctattcatctttccagatcc

SEQ ID NO: 1838 - DNA, 20 bp, Artificial sequence
  Synthetic oligonucleotide
ctcaagtcttcctcctgctg

SEQ ID NO: 1839 - DNA, 20 bp, Artificial sequence
  Synthetic oligonucleotide
tctcaagtcttcctcctgct

SEQ ID NO: 1840 - DNA, 20 bp, Artificial sequence
  Synthetic oligonucleotide
ctctcaagtcttcctcctgc

SEQ ID NO: 1841 - DNA, 20 bp, Artificial sequence
  Synthetic oligonucleotide
gctctcaagtcttcctcctg

SEQ ID NO: 1842 - DNA, 20 bp, Artificial sequence
  Synthetic oligonucleotide
gagctctcaagtcttcctcc

SEQ ID NO: 1843 - DNA, 20 bp, Artificial sequence
  Synthetic oligonucleotide
tgagctctcaagtcttcctc

SEQ ID NO: 1844 - DNA, 20 bp, Artificial sequence
  Synthetic oligonucleotide
atgagctctcaagtcttcct

SEQ ID NO: 1845 - DNA, 20 bp, Artificial sequence
  Synthetic oligonucleotide
catgagctctcaagtcttcc

SEQ ID NO: 1846 - DNA, 20 bp, Artificial sequence
  Synthetic oligonucleotide
cataatctgcacaggttctt

SEQ ID NO: 1847 - DNA, 20 bp, Artificial sequence
  Synthetic oligonucleotide
ccataatctgcacaggttct

SEQ ID NO: 1848 - DNA, 20 bp, Artificial sequence
  Synthetic oligonucleotide
accataatctgcacaggttc

SEQ ID NO: 1849 - DNA, 20 bp, Artificial sequence
  Synthetic oligonucleotide
caccataatctgcacaggtt

SEQ ID NO: 1850 - DNA, 20 bp, Artificial sequence
  Synthetic oligonucleotide
tgcaccataatctgcacagg

SEQ ID NO: 1851 - DNA, 20 bp, Artificial sequence
  Synthetic oligonucleotide
ctgcaccataatctgcacag

SEQ ID NO: 1852 - DNA, 20 bp, Artificial sequence
  Synthetic oligonucleotide
tctgcaccataatctgcaca

SEQ ID NO: 1853 - DNA, 20 bp, Artificial sequence
  Synthetic oligonucleotide
atctgcaccataatctgcac

SEQ ID NO: 1854 - DNA, 20 bp, Artificial sequence
  Synthetic oligonucleotide
taatccaggattgtcataag

SEQ ID NO: 1855 - DNA, 20 bp, Artificial sequence
  Synthetic oligonucleotide
ttaatccaggattgtcataa

SEQ ID NO: 1856 - DNA, 20 bp, Artificial sequence
  Synthetic oligonucleotide
tttaatccaggattgtcata

SEQ ID NO: 1857 - DNA, 20 bp, Artificial sequence
  Synthetic oligonucleotide
ctttaatccaggattgtcat

SEQ ID NO: 1858 - DNA, 20 bp, Artificial sequence
  Synthetic oligonucleotide
agctttaatccaggattgtc

SEQ ID NO: 1859 - DNA, 20 bp, Artificial sequence
  Synthetic oligonucleotide
tagctttaatccaggattgt

SEQ ID NO: 1860 - DNA, 20 bp, Artificial sequence
  Synthetic oligonucleotide
ttagctttaatccaggattg

SEQ ID NO: 1861 - DNA, 20 bp, Artificial sequence
  Synthetic oligonucleotide
cttagctttaatccaggatt

SEQ ID NO: 1862 - DNA, 20 bp, Artificial sequence
  Synthetic oligonucleotide
tccttagctttaatccagga

SEQ ID NO: 1863 - DNA, 20 bp, Artificial sequence
  Synthetic oligonucleotide
ctccttagctttaatccagg

SEQ ID NO: 1864 - DNA, 20 bp, Artificial sequence
  Synthetic oligonucleotide
cctccttagctttaatccag

SEQ ID NO: 1865 - DNA, 20 bp, Artificial sequence
  Synthetic oligonucleotide
tcctccttagctttaatcca

SEQ ID NO: 1866 - DNA, 20 bp, Artificial sequence
  Synthetic oligonucleotide
tgtcctccttagctttaatc

SEQ ID NO: 1867 - DNA, 20 bp, Artificial sequence
  Synthetic oligonucleotide
gtgtcctccttagctttaat

SEQ ID NO: 1868 - DNA, 20 bp, Artificial sequence
  Synthetic oligonucleotide
agtgtcctccttagctttaa

SEQ ID NO: 1869 - DNA, 20 bp, Artificial sequence
  Synthetic oligonucleotide
cagtgtcctccttagcttta

SEQ ID NO: 1870 - DNA, 20 bp, Artificial sequence
  Synthetic oligonucleotide
ctcagtgtcctccttagctt

SEQ ID NO: 1871 - DNA, 20 bp, Artificial sequence
  Synthetic oligonucleotide
actcagtgtcctccttagct

SEQ ID NO: 1872 - DNA, 20 bp, Artificial sequence
  Synthetic oligonucleotide
gactcagtgtcctccttagc

SEQ ID NO: 1873 - DNA, 20 bp, Artificial sequence
  Synthetic oligonucleotide
ggactcagtgtcctccttag

SEQ ID NO: 1874 - DNA, 20 bp, Artificial sequence
  Synthetic oligonucleotide
tgggactcagtgtcctcctt

SEQ ID NO: 1875 - DNA, 20 bp, Artificial sequence
  Synthetic oligonucleotide
ctgggactcagtgtcctcct

SEQ ID NO: 1876 - DNA, 20 bp, Artificial sequence
  Synthetic oligonucleotide
cctgggactcagtgtcctcc

SEQ ID NO: 1877 - DNA, 20 bp, Artificial sequence
  Synthetic oligonucleotide
ccctgggactcagtgtcctc

SEQ ID NO: 1878 - DNA, 20 bp, Artificial sequence
  Synthetic oligonucleotide
tcctgtttgatgggtaaaat

SEQ ID NO: 1879 - DNA, 20 bp, Artificial sequence
  Synthetic oligonucleotide
ctcctgtttgatgggtaaaa

SEQ ID NO: 1880 - DNA, 20 bp, Artificial sequence
  Synthetic oligonucleotide
tctcctgtttgatgggtaaa

SEQ ID NO: 1881 - DNA, 20 bp, Artificial sequence
  Synthetic oligonucleotide
ctctcctgtttgatgggtaa

SEQ ID NO: 1882 - DNA, 20 bp, Artificial sequence
  Synthetic oligonucleotide
tcctctcctgtttgatgggt

SEQ ID NO: 1883 - DNA, 20 bp, Artificial sequence
  Synthetic oligonucleotide
gtcctctcctgtttgatggg

SEQ ID NO: 1884 - DNA, 20 bp, Artificial sequence
  Synthetic oligonucleotide
tgtcctctcctgtttgatgg

SEQ ID NO: 1885 - DNA, 20 bp, Artificial sequence
  Synthetic oligonucleotide
gtgtcctctcctgtttgatg

SEQ ID NO: 1886 - DNA, 20 bp, Artificial sequence
  Synthetic oligonucleotide
cggtgtcctctcctgtttga

SEQ ID NO: 1887 - DNA, 20 bp, Artificial sequence
  Synthetic oligonucleotide
tcggtgtcctctcctgtttg

SEQ ID NO: 1888 - DNA, 20 bp, Artificial sequence
  Synthetic oligonucleotide
ctcggtgtcctctcctgttt

SEQ ID NO: 1889 - DNA, 20 bp, Artificial sequence
  Synthetic oligonucleotide
cctcggtgtcctctcctgtt

SEQ ID NO: 1890 - DNA, 20 bp, Artificial sequence
  Synthetic oligonucleotide
agcctcggtgtcctctcctg

SEQ ID NO: 1891 - DNA, 20 bp, Artificial sequence
  Synthetic oligonucleotide
aagcctcggtgtcctctcct

SEQ ID NO: 1892 - DNA, 20 bp, Artificial sequence
  Synthetic oligonucleotide
taagcctcggtgtcctctcc

SEQ ID NO: 1893 - DNA, 20 bp, Artificial sequence
  Synthetic oligonucleotide
gtaagcctcggtgtcctctc

SEQ ID NO: 1894 - DNA, 20 bp, Artificial sequence
  Synthetic oligonucleotide
aagtaagcctcggtgtcctc

SEQ ID NO: 1895 - DNA, 20 bp, Artificial sequence
  Synthetic oligonucleotide
caagtaagcctcggtgtcct

SEQ ID NO: 1896 - DNA, 20 bp, Artificial sequence
  Synthetic oligonucleotide
accaagtaagcctcggtgtc

SEQ ID NO: 1897 - DNA, 20 bp, Artificial sequence
  Synthetic oligonucleotide
ctcaccagattgttgtggga

SEQ ID NO: 1898 - DNA, 20 bp, Artificial sequence
  Synthetic oligonucleotide
cctcaccagattgttgtggg

SEQ ID NO: 1899 - DNA, 20 bp, Artificial sequence
  Synthetic oligonucleotide
acctcaccagattgttgtgg

SEQ ID NO: 1900 - DNA, 20 bp, Artificial sequence
  Synthetic oligonucleotide
tacctcaccagattgttgtg

SEQ ID NO: 1901 - DNA, 20 bp, Artificial sequence
  Synthetic oligonucleotide
taatacctacctcaccagat

SEQ ID NO: 1902 - DNA, 20 bp, Artificial sequence
  Synthetic oligonucleotide
ctaatacctacctcaccaga

SEQ ID NO: 1903 - DNA, 20 bp, Artificial sequence
  Synthetic oligonucleotide
gctaatacctacctcaccag

SEQ ID NO: 1904 - DNA, 20 bp, Artificial sequence
  Synthetic oligonucleotide
ggctaatacctacctcacca

SEQ ID NO: 1905 - DNA, 20 bp, Artificial sequence
  Synthetic oligonucleotide
cttcctcatctatacagtgg

SEQ ID NO: 1906 - DNA, 20 bp, Artificial sequence
  Synthetic oligonucleotide
gcttcctcatctatacagtg

SEQ ID NO: 1907 - DNA, 20 bp, Artificial sequence
  Synthetic oligonucleotide
agcttcctcatctatacagt

SEQ ID NO: 1908 - DNA, 20 bp, Artificial sequence
  Synthetic oligonucleotide
cagcttcctcatctatacag

SEQ ID NO: 1909 - DNA, 20 bp, Artificial sequence
  Synthetic oligonucleotide
ccatactggcatctggcagg

SEQ ID NO: 1910 - DNA, 20 bp, Artificial sequence
  Synthetic oligonucleotide
tccatactggcatctggcag

SEQ ID NO: 1911 - DNA, 20 bp, Artificial sequence
  Synthetic oligonucleotide
ctccatactggcatctggca

SEQ ID NO: 1912 - DNA, 20 bp, Artificial sequence
  Synthetic oligonucleotide
cctccatactggcatctggc

SEQ ID NO: 1913 - DNA, 20 bp, Artificial sequence
  Synthetic oligonucleotide
cacctccatactggcatctg

SEQ ID NO: 1914 - DNA, 20 bp, Artificial sequence
  Synthetic oligonucleotide
tcacctccatactggcatct

SEQ ID NO: 1915 - DNA, 20 bp, Artificial sequence
  Synthetic oligonucleotide
ctcacctccatactggcatc

SEQ ID NO: 1916 - DNA, 20 bp, Artificial sequence
  Synthetic oligonucleotide
cctcacctccatactggcat

SEQ ID NO: 1917 - DNA, 20 bp, Artificial sequence
  Synthetic oligonucleotide
cacctcacctccatactggc

SEQ ID NO: 1918 - DNA, 20 bp, Artificial sequence
  Synthetic oligonucleotide
ccacctcacctccatactgg

SEQ ID NO: 1919 - DNA, 20 bp, Artificial sequence
  Synthetic oligonucleotide
cccacctcacctccatactg

SEQ ID NO: 1920 - DNA, 20 bp, Artificial sequence
  Synthetic oligonucleotide
acccacctcacctccatact

SEQ ID NO: 1921 - DNA, 20 bp, Artificial sequence
  Synthetic oligonucleotide
ggatgcttaacttctgctga

SEQ ID NO: 1922 - DNA, 20 bp, Artificial sequence
  Synthetic oligonucleotide
aggatgcttaacttctgctg

SEQ ID NO: 1923 - DNA, 20 bp, Artificial sequence
  Synthetic oligonucleotide
taggatgcttaacttctgct

SEQ ID NO: 1924 - DNA, 20 bp, Artificial sequence
  Synthetic oligonucleotide
ttaggatgcttaacttctgc

SEQ ID NO: 1925 - DNA, 20 bp, Artificial sequence
  Synthetic oligonucleotide
agttaggatgcttaacttct

SEQ ID NO: 1926 - DNA, 20 bp, Artificial sequence
  Synthetic oligonucleotide
aagttaggatgcttaacttc

SEQ ID NO: 1927 - DNA, 20 bp, Artificial sequence
  Synthetic oligonucleotide
taagttaggatgcttaactt

SEQ ID NO: 1928 - DNA, 20 bp, Artificial sequence
  Synthetic oligonucleotide
ttaagttaggatgcttaact

SEQ ID NO: 1929 - DNA, 20 bp, Artificial sequence
  Synthetic oligonucleotide
tataggcctggatgcccaag

SEQ ID NO: 1930 - DNA, 20 bp, Artificial sequence
  Synthetic oligonucleotide
ctataggcctggatgcccaa

SEQ ID NO: 1931 - DNA, 20 bp, Artificial sequence
  Synthetic oligonucleotide
agatgatgtcctgcctcaga

SEQ ID NO: 1932 - DNA, 20 bp, Artificial sequence
  Synthetic oligonucleotide
cagatgatgtcctgcctcag

SEQ ID NO: 1933 - DNA, 20 bp, Artificial sequence
  Synthetic oligonucleotide
gcagatgatgtcctgcctca

SEQ ID NO: 1934 - DNA, 20 bp, Artificial sequence
  Synthetic oligonucleotide
agcagatgatgtcctgcctc

SEQ ID NO: 1935 - DNA, 20 bp, Artificial sequence
  Synthetic oligonucleotide
agtcaaaggtggcttcctgg

SEQ ID NO: 1936 - DNA, 20 bp, Artificial sequence
  Synthetic oligonucleotide
tagtcaaaggtggcttcctg

SEQ ID NO: 1937 - DNA, 20 bp, Artificial sequence
  Synthetic oligonucleotide
gtagtcaaaggtggcttcct

SEQ ID NO: 1938 - DNA, 20 bp, Artificial sequence
  Synthetic oligonucleotide
agtagtcaaaggtggcttcc

SEQ ID NO: 1939 - DNA, 20 bp, Artificial sequence
  Synthetic oligonucleotide
atgagtagtcaaaggtggct

SEQ ID NO: 1940 - DNA, 20 bp, Artificial sequence
  Synthetic oligonucleotide
aatgagtagtcaaaggtggc

SEQ ID NO: 1941 - DNA, 20 bp, Artificial sequence
  Synthetic oligonucleotide
gaatgagtagtcaaaggtgg

SEQ ID NO: 1942 - DNA, 20 bp, Artificial sequence
  Synthetic oligonucleotide
gcctggatgcccaagttaga

SEQ ID NO: 1943 - DNA, 20 bp, Artificial sequence
  Synthetic oligonucleotide
ggcctggatgcccaagttag

SEQ ID NO: 1944 - DNA, 20 bp, Artificial sequence
  Synthetic oligonucleotide
aggcctggatgcccaagtta

SEQ ID NO: 1945 - DNA, 20 bp, Artificial sequence
  Synthetic oligonucleotide
taggcctggatgcccaagtt

SEQ ID NO: 1946 - DNA, 20 bp, Artificial sequence
  Synthetic oligonucleotide
acaagtgggaaatgcagtct

SEQ ID NO: 1947 - DNA, 20 bp, Artificial sequence
  Synthetic oligonucleotide
aacaagtgggaaatgcagtc

SEQ ID NO: 1948 - DNA, 20 bp, Artificial sequence
  Synthetic oligonucleotide
caacaagtgggaaatgcagt

SEQ ID NO: 1949 - DNA, 20 bp, Artificial sequence
  Synthetic oligonucleotide
ccaacaagtgggaaatgcag

SEQ ID NO: 1950 - DNA, 20 bp, Artificial sequence
  Synthetic oligonucleotide
tgccaacaagtgggaaatgc

SEQ ID NO: 1951 - DNA, 20 bp, Artificial sequence
  Synthetic oligonucleotide
ctgccaacaagtgggaaatg

SEQ ID NO: 1952 - DNA, 20 bp, Artificial sequence
  Synthetic oligonucleotide
tctgccaacaagtgggaaat

SEQ ID NO: 1953 - DNA, 20 bp, Artificial sequence
  Synthetic oligonucleotide
ctctgccaacaagtgggaaa

SEQ ID NO: 1954 - DNA, 20 bp, Artificial sequence
  Synthetic oligonucleotide
gcttattaggtgtcttaaaa

SEQ ID NO: 1955 - DNA, 20 bp, Artificial sequence
  Synthetic oligonucleotide
agcttattaggtgtcttaaa

SEQ ID NO: 1956 - DNA, 20 bp, Artificial sequence
  Synthetic oligonucleotide
aagcttattaggtgtcttaa

SEQ ID NO: 1957 - DNA, 20 bp, Artificial sequence
  Synthetic oligonucleotide
taagcttattaggtgtctta

SEQ ID NO: 1958 - DNA, 20 bp, Artificial sequence
  Synthetic oligonucleotide
gctaagcttattaggtgtct

SEQ ID NO: 1959 - DNA, 20 bp, Artificial sequence
  Synthetic oligonucleotide
tgctaagcttattaggtgtc

SEQ ID NO: 1960 - DNA, 20 bp, Artificial sequence
  Synthetic oligonucleotide
ctgctaagcttattaggtgt

SEQ ID NO: 1961 - DNA, 20 bp, Artificial sequence
  Synthetic oligonucleotide
tctgctaagcttattaggtg

SEQ ID NO: 1962 - DNA, 20 bp, Artificial sequence
  Synthetic oligonucleotide
ccccatgcagcttggaggag

SEQ ID NO: 1963 - DNA, 20 bp, Artificial sequence
  Synthetic oligonucleotide
cccccatgcagcttggagga

SEQ ID NO: 1964 - DNA, 20 bp, Artificial sequence
  Synthetic oligonucleotide
gcccccatgcagcttggagg

SEQ ID NO: 1965 - DNA, 20 bp, Artificial sequence
  Synthetic oligonucleotide
agcccccatgcagcttggag

SEQ ID NO: 1966 - DNA, 20 bp, Artificial sequence
  Synthetic oligonucleotide
ccagcccccatgcagcttgg

SEQ ID NO: 1967 - DNA, 20 bp, Artificial sequence
  Synthetic oligonucleotide
gccagcccccatgcagcttg

SEQ ID NO: 1968 - DNA, 20 bp, Artificial sequence
  Synthetic oligonucleotide
ggccagcccccatgcagctt

SEQ ID NO: 1969 - DNA, 20 bp, Artificial sequence
  Synthetic oligonucleotide
gggccagcccccatgcagct

SEQ ID NO: 1970 - DNA, 20 bp, Artificial sequence
  Synthetic oligonucleotide
agtccaaacactcaggtagg

SEQ ID NO: 1971 - DNA, 20 bp, Artificial sequence
  Synthetic oligonucleotide
cagtccaaacactcaggtag

SEQ ID NO: 1972 - DNA, 20 bp, Artificial sequence
  Synthetic oligonucleotide
tcagtccaaacactcaggta

SEQ ID NO: 1973 - DNA, 20 bp, Artificial sequence
  Synthetic oligonucleotide
ttcagtccaaacactcaggt

SEQ ID NO: 1974 - DNA, 20 bp, Artificial sequence
  Synthetic oligonucleotide
gggaacagcagcatcagcat

SEQ ID NO: 1975 - DNA, 20 bp, Artificial sequence
  Synthetic oligonucleotide
tgggaacagcagcatcagca

SEQ ID NO: 1976 - DNA, 20 bp, Artificial sequence
  Synthetic oligonucleotide
ctgggaacagcagcatcagc

SEQ ID NO: 1977 - DNA, 20 bp, Artificial sequence
  Synthetic oligonucleotide
tctgggaacagcagcatcag

SEQ ID NO: 1978 - DNA, 20 bp, Artificial sequence
  Synthetic oligonucleotide
ggtctgggaacagcagcatc

SEQ ID NO: 1979 - DNA, 20 bp, Artificial sequence
  Synthetic oligonucleotide
tggtctgggaacagcagcat

SEQ ID NO: 1980 - DNA, 20 bp, Artificial sequence
  Synthetic oligonucleotide
gtggtctgggaacagcagca

SEQ ID NO: 1981 - DNA, 20 bp, Artificial sequence
  Synthetic oligonucleotide
caagtcatcttccagcagct

SEQ ID NO: 1982 - DNA, 20 bp, Artificial sequence
  Synthetic oligonucleotide
acaagtcatcttccagcagc

SEQ ID NO: 1983 - DNA, 20 bp, Artificial sequence
  Synthetic oligonucleotide
gacaagtcatcttccagcag

SEQ ID NO: 1984 - DNA, 20 bp, Artificial sequence
  Synthetic oligonucleotide
ggacaagtcatcttccagca

SEQ ID NO: 1985 - DNA, 20 bp, Artificial sequence
  Synthetic oligonucleotide
ctggacaagtcatcttccag

SEQ ID NO: 1986 - DNA, 20 bp, Artificial sequence
  Synthetic oligonucleotide
gctggacaagtcatcttcca

SEQ ID NO: 1987 - DNA, 20 bp, Artificial sequence
  Synthetic oligonucleotide
ggctggacaagtcatcttcc

SEQ ID NO: 1988 - DNA, 20 bp, Artificial sequence
  Synthetic oligonucleotide
gggctggacaagtcatcttc

SEQ ID NO: 1989 - DNA, 20 bp, Artificial sequence
  Synthetic oligonucleotide
atccttgagggtctcataac

SEQ ID NO: 1990 - DNA, 20 bp, Artificial sequence
  Synthetic oligonucleotide
tatccttgagggtctcataa

SEQ ID NO: 1991 - DNA, 20 bp, Artificial sequence
  Synthetic oligonucleotide
cttatccttgagggtctcat

SEQ ID NO: 1992 - DNA, 20 bp, Artificial sequence
  Synthetic oligonucleotide
tgcttatccttgagggtctc

SEQ ID NO: 1993 - DNA, 20 bp, Artificial sequence
  Synthetic oligonucleotide
atgcttatccttgagggtct

SEQ ID NO: 1994 - DNA, 20 bp, Artificial sequence
  Synthetic oligonucleotide
catgcttatccttgagggtc

SEQ ID NO: 1995 - DNA, 20 bp, Artificial sequence
  Synthetic oligonucleotide
acatgcttatccttgagggt

SEQ ID NO: 1996 - DNA, 20 bp, Artificial sequence
  Synthetic oligonucleotide
ctggatggcaacctaaggag

SEQ ID NO: 1997 - DNA, 20 bp, Artificial sequence
  Synthetic oligonucleotide
cctggatggcaacctaagga

SEQ ID NO: 1998 - DNA, 20 bp, Artificial sequence
  Synthetic oligonucleotide
gcctggatggcaacctaagg

SEQ ID NO: 1999 - DNA, 20 bp, Artificial sequence
  Synthetic oligonucleotide
ggcctggatggcaacctaag

SEQ ID NO: 2000 - DNA, 20 bp, Artificial sequence
  Synthetic oligonucleotide
ctggcctggatggcaaccta

SEQ ID NO: 2001 - DNA, 20 bp, Artificial sequence
  Synthetic oligonucleotide
tgctatgctgagagcacagg

SEQ ID NO: 2002 - DNA, 20 bp, Artificial sequence
  Synthetic oligonucleotide
ctgctatgctgagagcacag

SEQ ID NO: 2003 - DNA, 20 bp, Artificial sequence
  Synthetic oligonucleotide
cctgctatgctgagagcaca

SEQ ID NO: 2004 - DNA, 20 bp, Artificial sequence
  Synthetic oligonucleotide
acctgctatgctgagagcac

SEQ ID NO: 2005 - DNA, 20 bp, Artificial sequence
  Synthetic oligonucleotide
ctacctgctatgctgagagc

SEQ ID NO: 2006 - DNA, 20 bp, Artificial sequence
  Synthetic oligonucleotide
gctacctgctatgctgagag

SEQ ID NO: 2007 - DNA, 20 bp, Artificial sequence
  Synthetic oligonucleotide
agctacctgctatgctgaga

SEQ ID NO: 2008 - DNA, 20 bp, Artificial sequence
  Synthetic oligonucleotide
aagctacctgctatgctgag

SEQ ID NO: 2009 - DNA, 20 bp, Artificial sequence
  Synthetic oligonucleotide
gcaggttcatctgccttgac

SEQ ID NO: 2010 - DNA, 20 bp, Artificial sequence
  Synthetic oligonucleotide
agcaggttcatctgccttga

SEQ ID NO: 2011 - DNA, 20 bp, Artificial sequence
  Synthetic oligonucleotide
gagcaggttcatctgccttg

SEQ ID NO: 2012 - DNA, 20 bp, Artificial sequence
  Synthetic oligonucleotide
ggagcaggttcatctgcctt

SEQ ID NO: 2013 - DNA, 20 bp, Artificial sequence
  Synthetic oligonucleotide
ctgtgatgctctggagcagg

SEQ ID NO: 2014 - DNA, 20 bp, Artificial sequence
  Synthetic oligonucleotide
tctgtgatgctctggagcag

SEQ ID NO: 2015 - DNA, 20 bp, Artificial sequence
  Synthetic oligonucleotide
ctctgtgatgctctggagca

SEQ ID NO: 2016 - DNA, 20 bp, Artificial sequence
  Synthetic oligonucleotide
actctgtgatgctctggagc

SEQ ID NO: 2017 - DNA, 20 bp, Artificial sequence
  Synthetic oligonucleotide
gcactctgtgatgctctgga

SEQ ID NO: 2018 - DNA, 20 bp, Artificial sequence
  Synthetic oligonucleotide
tgcactctgtgatgctctgg

SEQ ID NO: 2019 - DNA, 20 bp, Artificial sequence
  Synthetic oligonucleotide
atgcactctgtgatgctctg

SEQ ID NO: 2020 - DNA, 20 bp, Artificial sequence
  Synthetic oligonucleotide
aatgcactctgtgatgctct

SEQ ID NO: 2021 - DNA, 20 bp, Artificial sequence
  Synthetic oligonucleotide
tgacatggtaagtcctgatg

SEQ ID NO: 2022 - DNA, 20 bp, Artificial sequence
  Synthetic oligonucleotide
ctgacatggtaagtcctgat

SEQ ID NO: 2023 - DNA, 20 bp, Artificial sequence
  Synthetic oligonucleotide
actgacatggtaagtcctga

SEQ ID NO: 2024 - DNA, 20 bp, Artificial sequence
  Synthetic oligonucleotide
cactgacatggtaagtcctg

SEQ ID NO: 2025 - DNA, 20 bp, Artificial sequence
  Synthetic oligonucleotide
agcactgacatggtaagtcc

SEQ ID NO: 2026 - DNA, 20 bp, Artificial sequence
  Synthetic oligonucleotide
cagcactgacatggtaagtc

SEQ ID NO: 2027 - DNA, 20 bp, Artificial sequence
  Synthetic oligonucleotide
tcagcactgacatggtaagt

SEQ ID NO: 2028 - DNA, 20 bp, Artificial sequence
  Synthetic oligonucleotide
ctcagcactgacatggtaag

SEQ ID NO: 2029 - DNA, 20 bp, Artificial sequence
  Synthetic oligonucleotide
ctgccatttaatgagcttca

SEQ ID NO: 2030 - DNA, 20 bp, Artificial sequence
  Synthetic oligonucleotide
tctgccatttaatgagcttc

SEQ ID NO: 2031 - DNA, 20 bp, Artificial sequence
  Synthetic oligonucleotide
ctctgccatttaatgagctt

SEQ ID NO: 2032 - DNA, 20 bp, Artificial sequence
  Synthetic oligonucleotide
actctgccatttaatgagct

SEQ ID NO: 2033 - DNA, 20 bp, Artificial sequence
  Synthetic oligonucleotide
caactctgccatttaatgag

SEQ ID NO: 2034 - DNA, 20 bp, Artificial sequence
  Synthetic oligonucleotide
ccaactctgccatttaatga

SEQ ID NO: 2035 - DNA, 20 bp, Artificial sequence
  Synthetic oligonucleotide
cccaactctgccatttaatg

SEQ ID NO: 2036 - DNA, 20 bp, Artificial sequence
  Synthetic oligonucleotide
tcccaactctgccatttaat

SEQ ID NO: 2037 - DNA, 20 bp, Artificial sequence
  Synthetic oligonucleotide
aatcccaactctgccattta

SEQ ID NO: 2038 - DNA, 20 bp, Artificial sequence
  Synthetic oligonucleotide
aaatcccaactctgccattt

SEQ ID NO: 2039 - DNA, 20 bp, Artificial sequence
  Synthetic oligonucleotide
tttaagggttcatggatccc

SEQ ID NO: 2040 - DNA, 20 bp, Artificial sequence
  Synthetic oligonucleotide
ttttaagggttcatggatcc

SEQ ID NO: 2041 - DNA, 20 bp, Artificial sequence
  Synthetic oligonucleotide
attttaagggttcatggatc

SEQ ID NO: 2042 - DNA, 20 bp, Artificial sequence
  Synthetic oligonucleotide
aattttaagggttcatggat

SEQ ID NO: 2043 - DNA, 20 bp, Artificial sequence
  Synthetic oligonucleotide
tggagtccctgggttcttgt

SEQ ID NO: 2044 - DNA, 20 bp, Artificial sequence
  Synthetic oligonucleotide
ctggagtccctgggttcttg

SEQ ID NO: 2045 - DNA, 20 bp, Artificial sequence
  Synthetic oligonucleotide
gctggagtccctgggttctt

SEQ ID NO: 2046 - DNA, 20 bp, Artificial sequence
  Synthetic oligonucleotide
ggctggagtccctgggttct

SEQ ID NO: 2047 - DNA, 20 bp, Artificial sequence
  Synthetic oligonucleotide
gaggctggagtccctgggtt

SEQ ID NO: 2048 - DNA, 20 bp, Artificial sequence
  Synthetic oligonucleotide
ggaggctggagtccctgggt

SEQ ID NO: 2049 - DNA, 20 bp, Artificial sequence
  Synthetic oligonucleotide
tgggaggctggagtccctgg

SEQ ID NO: 2050 - DNA, 20 bp, Artificial sequence
  Synthetic oligonucleotide
taccagccaggcccagaccc

SEQ ID NO: 2051 - DNA, 20 bp, Artificial sequence
  Synthetic oligonucleotide
ctaccagccaggcccagacc

SEQ ID NO: 2052 - DNA, 20 bp, Artificial sequence
  Synthetic oligonucleotide
cctaccagccaggcccagac

SEQ ID NO: 2053 - DNA, 20 bp, Artificial sequence
  Synthetic oligonucleotide
ccctaccagccaggcccaga

SEQ ID NO: 2054 - DNA, 20 bp, Artificial sequence
  Synthetic oligonucleotide
gtgttctacaagctgctcag

SEQ ID NO: 2055 - DNA, 20 bp, Artificial sequence
  Synthetic oligonucleotide
ggtgttctacaagctgctca

SEQ ID NO: 2056 - DNA, 20 bp, Artificial sequence
  Synthetic oligonucleotide
tggtgttctacaagctgctc

SEQ ID NO: 2057 - DNA, 20 bp, Artificial sequence
  Synthetic oligonucleotide
ctggtgttctacaagctgct

SEQ ID NO: 2058 - DNA, 20 bp, Artificial sequence
  Synthetic oligonucleotide
agctggtgttctacaagctg

SEQ ID NO: 2059 - DNA, 20 bp, Artificial sequence
  Synthetic oligonucleotide
gagctggtgttctacaagct

SEQ ID NO: 2060 - DNA, 20 bp, Artificial sequence
  Synthetic oligonucleotide
tgagctggtgttctacaagc

SEQ ID NO: 2061 - DNA, 20 bp, Artificial sequence
  Synthetic oligonucleotide
gtgagctggtgttctacaag

SEQ ID NO: 2062 - DNA, 20 bp, Artificial sequence
  Synthetic oligonucleotide
gtctgatcaattattaacct

SEQ ID NO: 2063 - DNA, 20 bp, Artificial sequence
  Synthetic oligonucleotide
ggtctgatcaattattaacc

SEQ ID NO: 2064 - DNA, 20 bp, Artificial sequence
  Synthetic oligonucleotide
gggtctgatcaattattaac

SEQ ID NO: 2065 - DNA, 20 bp, Artificial sequence
  Synthetic oligonucleotide
tgggtctgatcaattattaa

SEQ ID NO: 2066 - DNA, 20 bp, Artificial sequence
  Synthetic oligonucleotide
caggtactcatgtttggtgg

SEQ ID NO: 2067 - DNA, 20 bp, Artificial sequence
  Synthetic oligonucleotide
gcaggtactcatgtttggtg

SEQ ID NO: 2068 - DNA, 20 bp, Artificial sequence
  Synthetic oligonucleotide
agcaggtactcatgtttggt

SEQ ID NO: 2069 - DNA, 20 bp, Artificial sequence
  Synthetic oligonucleotide
cagcaggtactcatgtttgg

SEQ ID NO: 2070 - DNA, 20 bp, Artificial sequence
  Synthetic oligonucleotide
ggcagcaggtactcatgttt

SEQ ID NO: 2071 - DNA, 20 bp, Artificial sequence
  Synthetic oligonucleotide
gggcagcaggtactcatgtt

SEQ ID NO: 2072 - DNA, 20 bp, Artificial sequence
  Synthetic oligonucleotide
agggcagcaggtactcatgt

SEQ ID NO: 2073 - DNA, 20 bp, Artificial sequence
  Synthetic oligonucleotide
aagggcagcaggtactcatg

SEQ ID NO: 2074 - DNA, 20 bp, Artificial sequence
  Synthetic oligonucleotide
caatatcatactatctacat

SEQ ID NO: 2075 - DNA, 20 bp, Artificial sequence
  Synthetic oligonucleotide
ccaatatcatactatctaca

SEQ ID NO: 2076 - DNA, 20 bp, Artificial sequence
  Synthetic oligonucleotide
cccaatatcatactatctac

SEQ ID NO: 2077 - DNA, 20 bp, Artificial sequence
  Synthetic oligonucleotide
ccccaatatcatactatcta

SEQ ID NO: 2078 - DNA, 20 bp, Artificial sequence
  Synthetic oligonucleotide
ttccccaatatcatactatc

SEQ ID NO: 2079 - DNA, 20 bp, Artificial sequence
  Synthetic oligonucleotide
aacctttaaggcctatctca

SEQ ID NO: 2080 - DNA, 20 bp, Artificial sequence
  Synthetic oligonucleotide
caacctttaaggcctatctc

SEQ ID NO: 2081 - DNA, 20 bp, Artificial sequence
  Synthetic oligonucleotide
ccaacctttaaggcctatct

SEQ ID NO: 2082 - DNA, 20 bp, Artificial sequence
  Synthetic oligonucleotide
cccaacctttaaggcctatc

SEQ ID NO: 2083 - DNA, 20 bp, Artificial sequence
  Synthetic oligonucleotide
tacccaacctttaaggccta

SEQ ID NO: 2084 - DNA, 20 bp, Artificial sequence
  Synthetic oligonucleotide
ttacccaacctttaaggcct

SEQ ID NO: 2085 - DNA, 20 bp, Artificial sequence
  Synthetic oligonucleotide
tttacccaacctttaaggcc

SEQ ID NO: 2086 - DNA, 20 bp, Artificial sequence
  Synthetic oligonucleotide
ttttacccaacctttaaggc

SEQ ID NO: 2087 - DNA, 20 bp, Artificial sequence
  Synthetic oligonucleotide
ttttttacccaacctttaag

SEQ ID NO: 2088 - DNA, 20 bp, Artificial sequence
  Synthetic oligonucleotide
attttttacccaacctttaa

SEQ ID NO: 2089 - DNA, 20 bp, Artificial sequence
  Synthetic oligonucleotide
cattttttacccaaccttta

SEQ ID NO: 2090 - DNA, 20 bp, Artificial sequence
  Synthetic oligonucleotide
ccattttttacccaaccttt

SEQ ID NO: 2091 - DNA, 20 bp, Artificial sequence
  Synthetic oligonucleotide
ttccattttttacccaacct

SEQ ID NO: 2092 - DNA, 20 bp, Artificial sequence
  Synthetic oligonucleotide
tttccattttttacccaacc

SEQ ID NO: 2093 - DNA, 20 bp, Artificial sequence
  Synthetic oligonucleotide
ctttccattttttacccaac

SEQ ID NO: 2094 - DNA, 20 bp, Artificial sequence
  Synthetic oligonucleotide
tctttccattttttacccaa

SEQ ID NO: 2095 - DNA, 20 bp, Artificial sequence
  Synthetic oligonucleotide
ttaggctttagaaattcacc

SEQ ID NO: 2096 - DNA, 20 bp, Artificial sequence
  Synthetic oligonucleotide
attaggctttagaaattcac

SEQ ID NO: 2097 - DNA, 20 bp, Artificial sequence
  Synthetic oligonucleotide
tatgcagcctggacaagtcc

SEQ ID NO: 2098 - DNA, 20 bp, Artificial sequence
  Synthetic oligonucleotide
catactagactatgcagcct

SEQ ID NO: 2099 - DNA, 20 bp, Artificial sequence
  Synthetic oligonucleotide
tcatactagactatgcagcc

SEQ ID NO: 2100 - DNA, 20 bp, Artificial sequence
  Synthetic oligonucleotide
atcatactagactatgcagc

SEQ ID NO: 2101 - DNA, 20 bp, Artificial sequence
  Synthetic oligonucleotide
catcatactagactatgcag

SEQ ID NO: 2102 - DNA, 20 bp, Artificial sequence
  Synthetic oligonucleotide
gccatcatactagactatgc

SEQ ID NO: 2103 - DNA, 20 bp, Artificial sequence
  Synthetic oligonucleotide
tgccatcatactagactatg

SEQ ID NO: 2104 - DNA, 20 bp, Artificial sequence
  Synthetic oligonucleotide
ttgccatcatactagactat

SEQ ID NO: 2105 - DNA, 20 bp, Artificial sequence
  Synthetic oligonucleotide
gttgccatcatactagacta

SEQ ID NO: 2106 - DNA, 20 bp, Artificial sequence
  Synthetic oligonucleotide
atgttgccatcatactagac

SEQ ID NO: 2107 - DNA, 20 bp, Artificial sequence
  Synthetic oligonucleotide
aatgttgccatcatactaga

SEQ ID NO: 2108 - DNA, 20 bp, Artificial sequence
  Synthetic oligonucleotide
caatgttgccatcatactag

SEQ ID NO: 2109 - DNA, 20 bp, Artificial sequence
  Synthetic oligonucleotide
gcaatgttgccatcatacta

SEQ ID NO: 2110 - DNA, 20 bp, Artificial sequence
  Synthetic oligonucleotide
ttgcaatgttgccatcatac

SEQ ID NO: 2111 - DNA, 20 bp, Artificial sequence
  Synthetic oligonucleotide
gttgcaatgttgccatcata

SEQ ID NO: 2112 - DNA, 20 bp, Artificial sequence
  Synthetic oligonucleotide
ggttgcaatgttgccatcat

SEQ ID NO: 2113 - DNA, 20 bp, Artificial sequence
  Synthetic oligonucleotide
tggttgcaatgttgccatca

SEQ ID NO: 2114 - DNA, 20 bp, Artificial sequence
  Synthetic oligonucleotide
ggtggttgcaatgttgccat

SEQ ID NO: 2115 - DNA, 20 bp, Artificial sequence
  Synthetic oligonucleotide
tggtggttgcaatgttgcca

SEQ ID NO: 2116 - DNA, 20 bp, Artificial sequence
  Synthetic oligonucleotide
atggtggttgcaatgttgcc

SEQ ID NO: 2117 - DNA, 20 bp, Artificial sequence
  Synthetic oligonucleotide
gatggtggttgcaatgttgc

SEQ ID NO: 2118 - DNA, 20 bp, Artificial sequence
  Synthetic oligonucleotide
tggatggtggttgcaatgtt

SEQ ID NO: 2119 - DNA, 20 bp, Artificial sequence
  Synthetic oligonucleotide
ctggatggtggttgcaatgt

SEQ ID NO: 2120 - DNA, 20 bp, Artificial sequence
  Synthetic oligonucleotide
cctggatggtggttgcaatg

SEQ ID NO: 2121 - DNA, 20 bp, Artificial sequence
  Synthetic oligonucleotide
gcctggatggtggttgcaat

SEQ ID NO: 2122 - DNA, 20 bp, Artificial sequence
  Synthetic oligonucleotide
aagcctggatggtggttgca

SEQ ID NO: 2123 - DNA, 20 bp, Artificial sequence
  Synthetic oligonucleotide
taagcctggatggtggttgc

SEQ ID NO: 2124 - DNA, 20 bp, Artificial sequence
  Synthetic oligonucleotide
ataagcctggatggtggttg

SEQ ID NO: 2125 - DNA, 20 bp, Artificial sequence
  Synthetic oligonucleotide
aataagcctggatggtggtt

SEQ ID NO: 2126 - DNA, 20 bp, Artificial sequence
  Synthetic oligonucleotide
aactgagatctccagcagca

SEQ ID NO: 2127 - DNA, 20 bp, Artificial sequence
  Synthetic oligonucleotide
aaactgagatctccagcagc

SEQ ID NO: 2128 - DNA, 20 bp, Artificial sequence
  Synthetic oligonucleotide
taaactgagatctccagcag

SEQ ID NO: 2129 - DNA, 20 bp, Artificial sequence
  Synthetic oligonucleotide
ttaaactgagatctccagca

SEQ ID NO: 2130 - DNA, 20 bp, Artificial sequence
  Synthetic oligonucleotide
gacaaagtctatcaggatgc

SEQ ID NO: 2131 - DNA, 20 bp, Artificial sequence
  Synthetic oligonucleotide
tgacaaagtctatcaggatg

SEQ ID NO: 2132 - DNA, 20 bp, Artificial sequence
  Synthetic oligonucleotide
gtgacaaagtctatcaggat

SEQ ID NO: 2133 - DNA, 20 bp, Artificial sequence
  Synthetic oligonucleotide
agtgacaaagtctatcagga

SEQ ID NO: 2134 - DNA, 20 bp, Artificial sequence
  Synthetic oligonucleotide
aaagtgacaaagtctatcag

SEQ ID NO: 2135 - DNA, 20 bp, Artificial sequence
  Synthetic oligonucleotide
gaaagtgacaaagtctatca

SEQ ID NO: 2136 - DNA, 20 bp, Artificial sequence
  Synthetic oligonucleotide
agaaagtgacaaagtctatc

SEQ ID NO: 2137 - DNA, 20 bp, Artificial sequence
  Synthetic oligonucleotide
ctagtgccccagggagccct

SEQ ID NO: 2138 - DNA, 20 bp, Artificial sequence
  Synthetic oligonucleotide
cctagtgccccagggagccc

SEQ ID NO: 2139 - DNA, 20 bp, Artificial sequence
  Synthetic oligonucleotide
tcctagtgccccagggagcc

SEQ ID NO: 2140 - DNA, 20 bp, Artificial sequence
  Synthetic oligonucleotide
gtcctagtgccccagggagc

SEQ ID NO: 2141 - DNA, 20 bp, Artificial sequence
  Synthetic oligonucleotide
ttgtcctagtgccccaggga

SEQ ID NO: 2142 - DNA, 20 bp, Artificial sequence
  Synthetic oligonucleotide
tttgtcctagtgccccaggg

SEQ ID NO: 2143 - DNA, 20 bp, Artificial sequence
  Synthetic oligonucleotide
ttttgtcctagtgccccagg

SEQ ID NO: 2144 - DNA, 20 bp, Artificial sequence
  Synthetic oligonucleotide
gtattctgctcataaaaaca

SEQ ID NO: 2145 - DNA, 20 bp, Artificial sequence
  Synthetic oligonucleotide
ggtattctgctcataaaaac

SEQ ID NO: 2146 - DNA, 20 bp, Artificial sequence
  Synthetic oligonucleotide
gggtattctgctcataaaaa

SEQ ID NO: 2147 - DNA, 20 bp, Artificial sequence
  Synthetic oligonucleotide
agggtattctgctcataaaa

SEQ ID NO: 2148 - DNA, 20 bp, Artificial sequence
  Synthetic oligonucleotide
taagggtattctgctcataa

SEQ ID NO: 2149 - DNA, 20 bp, Artificial sequence
  Synthetic oligonucleotide
gtaagggtattctgctcata

SEQ ID NO: 2150 - DNA, 20 bp, Artificial sequence
  Synthetic oligonucleotide
agtaagggtattctgctcat

SEQ ID NO: 2151 - DNA, 20 bp, Artificial sequence
  Synthetic oligonucleotide
gagtaagggtattctgctca

SEQ ID NO: 2152 - DNA, 20 bp, Artificial sequence
  Synthetic oligonucleotide
agacaatgagtaagggtatt

SEQ ID NO: 2153 - DNA, 20 bp, Artificial sequence
  Synthetic oligonucleotide
gagacaatgagtaagggtat

SEQ ID NO: 2154 - DNA, 20 bp, Artificial sequence
  Synthetic oligonucleotide
agagacaatgagtaagggta

SEQ ID NO: 2155 - DNA, 20 bp, Artificial sequence
  Synthetic oligonucleotide
gagagacaatgagtaagggt

SEQ ID NO: 2156 - DNA, 20 bp, Artificial sequence
  Synthetic oligonucleotide
gagagagacaatgagtaagg

SEQ ID NO: 2157 - DNA, 20 bp, Artificial sequence
  Synthetic oligonucleotide
tgagagagacaatgagtaag

SEQ ID NO: 2158 - DNA, 20 bp, Artificial sequence
  Synthetic oligonucleotide
ctgagagagacaatgagtaa

SEQ ID NO: 2159 - DNA, 20 bp, Artificial sequence
  Synthetic oligonucleotide
agcgacagccctgtgccagc

SEQ ID NO: 2160 - DNA, 20 bp, Artificial sequence
  Synthetic oligonucleotide
aagcgacagccctgtgccag

SEQ ID NO: 2161 - DNA, 20 bp, Artificial sequence
  Synthetic oligonucleotide
caagcgacagccctgtgcca

SEQ ID NO: 2162 - DNA, 20 bp, Artificial sequence
  Synthetic oligonucleotide
acaagcgacagccctgtgcc

SEQ ID NO: 2163 - DNA, 20 bp, Artificial sequence
  Synthetic oligonucleotide
ggacaagcgacagccctgtg

SEQ ID NO: 2164 - DNA, 20 bp, Artificial sequence
  Synthetic oligonucleotide
aggacaagcgacagccctgt

SEQ ID NO: 2165 - DNA, 20 bp, Artificial sequence
  Synthetic oligonucleotide
atgagacaggcagcccacct

SEQ ID NO: 2166 - DNA, 20 bp, Artificial sequence
  Synthetic oligonucleotide
aatgagacaggcagcccacc

SEQ ID NO: 2167 - DNA, 20 bp, Artificial sequence
  Synthetic oligonucleotide
gaatgagacaggcagcccac

SEQ ID NO: 2168 - DNA, 20 bp, Artificial sequence
  Synthetic oligonucleotide
agaatgagacaggcagccca

SEQ ID NO: 2169 - DNA, 20 bp, Artificial sequence
  Synthetic oligonucleotide
acagaatgagacaggcagcc

SEQ ID NO: 2170 - DNA, 20 bp, Artificial sequence
  Synthetic oligonucleotide
cacagaatgagacaggcagc

SEQ ID NO: 2171 - DNA, 20 bp, Artificial sequence
  Synthetic oligonucleotide
tcacagaatgagacaggcag

SEQ ID NO: 2172 - DNA, 20 bp, Artificial sequence
  Synthetic oligonucleotide
gctctgtgggctcctccaca

SEQ ID NO: 2173 - DNA, 20 bp, Artificial sequence
  Synthetic oligonucleotide
tgctctgtgggctcctccac

SEQ ID NO: 2174 - DNA, 20 bp, Artificial sequence
  Synthetic oligonucleotide
gtgctctgtgggctcctcca

SEQ ID NO: 2175 - DNA, 20 bp, Artificial sequence
  Synthetic oligonucleotide
tgtgctctgtgggctcctcc

SEQ ID NO: 2176 - DNA, 20 bp, Artificial sequence
  Synthetic oligonucleotide
cctgtgctctgtgggctcct

SEQ ID NO: 2177 - DNA, 20 bp, Artificial sequence
  Synthetic oligonucleotide
ccctgtgctctgtgggctcc

SEQ ID NO: 2178 - DNA, 20 bp, Artificial sequence
  Synthetic oligonucleotide
gccctgtgctctgtgggctc

SEQ ID NO: 2179 - DNA, 20 bp, Artificial sequence
  Synthetic oligonucleotide
ggccctgtgctctgtgggct

SEQ ID NO: 2180 - DNA, 20 bp, Artificial sequence
  Synthetic oligonucleotide
ttggccctgtgctctgtggg

SEQ ID NO: 2181 - DNA, 20 bp, Artificial sequence
  Synthetic oligonucleotide
cttggccctgtgctctgtgg

SEQ ID NO: 2182 - DNA, 20 bp, Artificial sequence
  Synthetic oligonucleotide
acttggccctgtgctctgtg

SEQ ID NO: 2183 - DNA, 20 bp, Artificial sequence
  Synthetic oligonucleotide
tacttggccctgtgctctgt

SEQ ID NO: 2184 - DNA, 20 bp, Artificial sequence
  Synthetic oligonucleotide
cactgtcagtctctccaaac

SEQ ID NO: 2185 - DNA, 20 bp, Artificial sequence
  Synthetic oligonucleotide
ccactgtcagtctctccaaa

SEQ ID NO: 2186 - DNA, 20 bp, Artificial sequence
  Synthetic oligonucleotide
cccactgtcagtctctccaa

SEQ ID NO: 2187 - DNA, 20 bp, Artificial sequence
  Synthetic oligonucleotide
ccccactgtcagtctctcca

SEQ ID NO: 2188 - DNA, 20 bp, Artificial sequence
  Synthetic oligonucleotide
gcccccactgtcagtctctc

SEQ ID NO: 2189 - DNA, 20 bp, Artificial sequence
  Synthetic oligonucleotide
tgcccccactgtcagtctct

SEQ ID NO: 2190 - DNA, 20 bp, Artificial sequence
  Synthetic oligonucleotide
ctgcccccactgtcagtctc

SEQ ID NO: 2191 - DNA, 20 bp, Artificial sequence
  Synthetic oligonucleotide
tctgcccccactgtcagtct

SEQ ID NO: 2192 - DNA, 20 bp, Artificial sequence
  Synthetic oligonucleotide
ttggctgcaagctctgcccc

SEQ ID NO: 2193 - DNA, 20 bp, Artificial sequence
  Synthetic oligonucleotide
cttggctgcaagctctgccc

SEQ ID NO: 2194 - DNA, 20 bp, Artificial sequence
  Synthetic oligonucleotide
ccttggctgcaagctctgcc

SEQ ID NO: 2195 - DNA, 20 bp, Artificial sequence
  Synthetic oligonucleotide
gccttggctgcaagctctgc

SEQ ID NO: 2196 - DNA, 20 bp, Artificial sequence
  Synthetic oligonucleotide
gggccttggctgcaagctct

SEQ ID NO: 2197 - DNA, 20 bp, Artificial sequence
  Synthetic oligonucleotide
ttattctaaaactcaaatcc

SEQ ID NO: 2198 - DNA, 20 bp, Artificial sequence
  Synthetic oligonucleotide
attattctaaaactcaaatc

SEQ ID NO: 2199 - DNA, 20 bp, Artificial sequence
  Synthetic oligonucleotide
tgattattctaaaactcaaa

SEQ ID NO: 2200 - DNA, 20 bp, Artificial sequence
  Synthetic oligonucleotide
agtgattattctaaaactca

SEQ ID NO: 2201 - DNA, 20 bp, Artificial sequence
  Synthetic oligonucleotide
gagtgattattctaaaactc

SEQ ID NO: 2202 - DNA, 20 bp, Artificial sequence
  Synthetic oligonucleotide
agagtgattattctaaaact

SEQ ID NO: 2203 - DNA, 20 bp, Artificial sequence
  Synthetic oligonucleotide
cagagtgattattctaaaac

SEQ ID NO: 2204 - DNA, 20 bp, Artificial sequence
  Synthetic oligonucleotide
tgttgggcagtcaccatttg

SEQ ID NO: 2205 - DNA, 20 bp, Artificial sequence
  Synthetic oligonucleotide
gtgttgggcagtcaccattt

SEQ ID NO: 2206 - DNA, 20 bp, Artificial sequence
  Synthetic oligonucleotide
ggtgttgggcagtcaccatt

SEQ ID NO: 2207 - DNA, 20 bp, Artificial sequence
  Synthetic oligonucleotide
tggtgttgggcagtcaccat

SEQ ID NO: 2208 - DNA, 20 bp, Artificial sequence
  Synthetic oligonucleotide
ccttgggtcagaggaaactg

SEQ ID NO: 2209 - DNA, 20 bp, Artificial sequence
  Synthetic oligonucleotide
accttgggtcagaggaaact

SEQ ID NO: 2210 - DNA, 20 bp, Artificial sequence
  Synthetic oligonucleotide
gaccttgggtcagaggaaac

SEQ ID NO: 2211 - DNA, 20 bp, Artificial sequence
  Synthetic oligonucleotide
tgaccttgggtcagaggaaa

SEQ ID NO: 2212 - DNA, 20 bp, Artificial sequence
  Synthetic oligonucleotide
gatgaccttgggtcagagga

SEQ ID NO: 2213 - DNA, 20 bp, Artificial sequence
  Synthetic oligonucleotide
ggatgaccttgggtcagagg

SEQ ID NO: 2214 - DNA, 20 bp, Artificial sequence
  Synthetic oligonucleotide
aggatgaccttgggtcagag

SEQ ID NO: 2215 - DNA, 20 bp, Artificial sequence
  Synthetic oligonucleotide
aaggatgaccttgggtcaga

SEQ ID NO: 2216 - DNA, 20 bp, Artificial sequence
  Synthetic oligonucleotide
gcaaggatgaccttgggtca

SEQ ID NO: 2217 - DNA, 20 bp, Artificial sequence
  Synthetic oligonucleotide
tgcaaggatgaccttgggtc

SEQ ID NO: 2218 - DNA, 20 bp, Artificial sequence
  Synthetic oligonucleotide
ctgcaaggatgaccttgggt

SEQ ID NO: 2219 - DNA, 20 bp, Artificial sequence
  Synthetic oligonucleotide
gctgcaaggatgaccttggg

SEQ ID NO: 2220 - DNA, 20 bp, Artificial sequence
  Synthetic oligonucleotide
cagctgcaaggatgaccttg

SEQ ID NO: 2221 - DNA, 20 bp, Artificial sequence
  Synthetic oligonucleotide
ccagctgcaaggatgacctt

SEQ ID NO: 2222 - DNA, 20 bp, Artificial sequence
  Synthetic oligonucleotide
caccagctgcaaggatgacc

SEQ ID NO: 2223 - DNA, 20 bp, Artificial sequence
  Synthetic oligonucleotide
tgtgttggctccctgtgtca

SEQ ID NO: 2224 - DNA, 20 bp, Artificial sequence
  Synthetic oligonucleotide
gtgtgttggctccctgtgtc

SEQ ID NO: 2225 - DNA, 20 bp, Artificial sequence
  Synthetic oligonucleotide
ggtgtgttggctccctgtgt

SEQ ID NO: 2226 - DNA, 20 bp, Artificial sequence
  Synthetic oligonucleotide
tggtgtgttggctccctgtg

SEQ ID NO: 2227 - DNA, 20 bp, Artificial sequence
  Synthetic oligonucleotide
aatggtgtgttggctccctg

SEQ ID NO: 2228 - DNA, 20 bp, Artificial sequence
  Synthetic oligonucleotide
gaatggtgtgttggctccct

SEQ ID NO: 2229 - DNA, 20 bp, Artificial sequence
  Synthetic oligonucleotide
ggaatggtgtgttggctccc

SEQ ID NO: 2230 - DNA, 20 bp, Artificial sequence
  Synthetic oligonucleotide
aggaatggtgtgttggctcc

SEQ ID NO: 2231 - DNA, 20 bp, Artificial sequence
  Synthetic oligonucleotide
caaggaatggtgtgttggct

SEQ ID NO: 2232 - DNA, 20 bp, Artificial sequence
  Synthetic oligonucleotide
ccaaggaatggtgtgttggc

SEQ ID NO: 2233 - DNA, 20 bp, Artificial sequence
  Synthetic oligonucleotide
accaaggaatggtgtgttgg

SEQ ID NO: 2234 - DNA, 20 bp, Artificial sequence
  Synthetic oligonucleotide
caccaaggaatggtgtgttg

SEQ ID NO: 2235 - DNA, 20 bp, Artificial sequence
  Synthetic oligonucleotide
agcaccaaggaatggtgtgt

SEQ ID NO: 2236 - DNA, 20 bp, Artificial sequence
  Synthetic oligonucleotide
cagcaccaaggaatggtgtg

SEQ ID NO: 2237 - DNA, 20 bp, Artificial sequence
  Synthetic oligonucleotide
ccagcaccaaggaatggtgt

SEQ ID NO: 2238 - DNA, 20 bp, Artificial sequence
  Synthetic oligonucleotide
cccagcaccaaggaatggtg

SEQ ID NO: 2239 - DNA, 20 bp, Artificial sequence
  Synthetic oligonucleotide
ggcccagcaccaaggaatgg

SEQ ID NO: 2240 - DNA, 20 bp, Artificial sequence
  Synthetic oligonucleotide
aggcccagcaccaaggaatg

SEQ ID NO: 2241 - DNA, 20 bp, Artificial sequence
  Synthetic oligonucleotide
caggcccagcaccaaggaat

SEQ ID NO: 2242 - DNA, 20 bp, Artificial sequence
  Synthetic oligonucleotide
gcaggcccagcaccaaggaa

SEQ ID NO: 2243 - DNA, 20 bp, Artificial sequence
  Synthetic oligonucleotide
atgcaggcccagcaccaagg

SEQ ID NO: 2244 - DNA, 20 bp, Artificial sequence
  Synthetic oligonucleotide
aatgcaggcccagcaccaag

SEQ ID NO: 2245 - DNA, 20 bp, Artificial sequence
  Synthetic oligonucleotide
caatgcaggcccagcaccaa

SEQ ID NO: 2246 - DNA, 20 bp, Artificial sequence
  Synthetic oligonucleotide
ccaatgcaggcccagcacca

SEQ ID NO: 2247 - DNA, 20 bp, Artificial sequence
  Synthetic oligonucleotide
ctgaacttcccctcccaaac

SEQ ID NO: 2248 - DNA, 20 bp, Artificial sequence
  Synthetic oligonucleotide
caaatctgaacttcccctcc

SEQ ID NO: 2249 - DNA, 20 bp, Artificial sequence
  Synthetic oligonucleotide
aaatgcaaatctgaacttcc

SEQ ID NO: 2250 - DNA, 20 bp, Artificial sequence
  Synthetic oligonucleotide
gcagctccaaggatcatttt

SEQ ID NO: 2251 - DNA, 20 bp, Artificial sequence
  Synthetic oligonucleotide
atccagcagctccaaggatc

SEQ ID NO: 2252 - DNA, 20 bp, Artificial sequence
  Synthetic oligonucleotide
cttccatccagcagctccaa

SEQ ID NO: 2253 - DNA, 20 bp, Artificial sequence
  Synthetic oligonucleotide
cccatcttccatccagcagc

SEQ ID NO: 2254 - DNA, 20 bp, Artificial sequence
  Synthetic oligonucleotide
tctaacccatcttccatcca

SEQ ID NO: 2255 - DNA, 20 bp, Artificial sequence
  Synthetic oligonucleotide
atttttctaacccatcttcc

SEQ ID NO: 2256 - DNA, 20 bp, Artificial sequence
  Synthetic oligonucleotide
cttccatttttctaacccat

SEQ ID NO: 2257 - DNA, 20 bp, Artificial sequence
  Synthetic oligonucleotide
gccactggctaccaaaacag

SEQ ID NO: 2258 - DNA, 20 bp, Artificial sequence
  Synthetic oligonucleotide
tccaagccactggctaccaa

SEQ ID NO: 2259 - DNA, 20 bp, Artificial sequence
  Synthetic oligonucleotide
cttggtccaagccactggct

SEQ ID NO: 2260 - DNA, 20 bp, Artificial sequence
  Synthetic oligonucleotide
actcccttggtccaagccac

SEQ ID NO: 2261 - DNA, 20 bp, Artificial sequence
  Synthetic oligonucleotide
ctgctactcccttggtccaa

SEQ ID NO: 2262 - DNA, 20 bp, Artificial sequence
  Synthetic oligonucleotide
ctccactgctactcccttgg

SEQ ID NO: 2263 - DNA, 20 bp, Artificial sequence
  Synthetic oligonucleotide
tccatctccactgctactcc

SEQ ID NO: 2264 - DNA, 20 bp, Artificial sequence
  Synthetic oligonucleotide
tctcttccatctccactgct

SEQ ID NO: 2265 - DNA, 20 bp, Artificial sequence
  Synthetic oligonucleotide
gcacatctcttccatctcca

SEQ ID NO: 2266 - DNA, 20 bp, Artificial sequence
  Synthetic oligonucleotide
atcatgcacatctcttccat

SEQ ID NO: 2267 - DNA, 20 bp, Artificial sequence
  Synthetic oligonucleotide
tatttctgaaatttttccca

SEQ ID NO: 2268 - DNA, 20 bp, Artificial sequence
  Synthetic oligonucleotide
aatgctatttctgaaatttt

SEQ ID NO: 2269 - DNA, 20 bp, Artificial sequence
  Synthetic oligonucleotide
caatccattcctatgtcctg

SEQ ID NO: 2270 - DNA, 20 bp, Artificial sequence
  Synthetic oligonucleotide
atacccaatccattcctatg

SEQ ID NO: 2271 - DNA, 20 bp, Artificial sequence
  Synthetic oligonucleotide
tctccatacccaatccattc

SEQ ID NO: 2272 - DNA, 20 bp, Artificial sequence
  Synthetic oligonucleotide
ctgcatctccatacccaatc

SEQ ID NO: 2273 - DNA, 20 bp, Artificial sequence
  Synthetic oligonucleotide
tcctgctgcatctccatacc

SEQ ID NO: 2274 - DNA, 20 bp, Artificial sequence
  Synthetic oligonucleotide
tcttatcctgctgcatctcc

SEQ ID NO: 2275 - DNA, 20 bp, Artificial sequence
  Synthetic oligonucleotide
tattttcttatcctgctgca

SEQ ID NO: 2276 - DNA, 20 bp, Artificial sequence
  Synthetic oligonucleotide
tgctttattttcttatcctg

SEQ ID NO: 2277 - DNA, 20 bp, Artificial sequence
  Synthetic oligonucleotide
accagcatttatgatctgtg

SEQ ID NO: 2278 - DNA, 20 bp, Artificial sequence
  Synthetic oligonucleotide
gacatgctttaaaaagtgta

SEQ ID NO: 2279 - DNA, 20 bp, Artificial sequence
  Synthetic oligonucleotide
aatgtgacatgctttaaaaa

SEQ ID NO: 2280 - DNA, 20 bp, Artificial sequence
  Synthetic oligonucleotide
agccattcctgcctctctga

SEQ ID NO: 2281 - DNA, 20 bp, Artificial sequence
  Synthetic oligonucleotide
gggcaagccattcctgcctc

SEQ ID NO: 2282 - DNA, 20 bp, Artificial sequence
  Synthetic oligonucleotide
gctctgggcaagccattcct

SEQ ID NO: 2283 - DNA, 20 bp, Artificial sequence
  Synthetic oligonucleotide
gctctgctctgggcaagcca

SEQ ID NO: 2284 - DNA, 20 bp, Artificial sequence
  Synthetic oligonucleotide
cttttgctctgctctgggca

SEQ ID NO: 2285 - DNA, 20 bp, Artificial sequence
  Synthetic oligonucleotide
ctttgcttttgctctgctct

SEQ ID NO: 2286 - DNA, 20 bp, Artificial sequence
  Synthetic oligonucleotide
aacatctttgcttttgctct

SEQ ID NO: 2287 - DNA, 20 bp, Artificial sequence
  Synthetic oligonucleotide
aagtaaacatctttgctttt

SEQ ID NO: 2288 - DNA, 20 bp, Artificial sequence
  Synthetic oligonucleotide
ggatcaagtaaacatctttg

SEQ ID NO: 2289 - DNA, 20 bp, Artificial sequence
  Synthetic oligonucleotide
tctgctaggagggtctatga

SEQ ID NO: 2290 - DNA, 20 bp, Artificial sequence
  Synthetic oligonucleotide
tgcattctgctaggagggtc

SEQ ID NO: 2291 - DNA, 20 bp, Artificial sequence
  Synthetic oligonucleotide
cccactgcattctgctagga

SEQ ID NO: 2292 - DNA, 20 bp, Artificial sequence
  Synthetic oligonucleotide
ttgaacccactgcattctgc

SEQ ID NO: 2293 - DNA, 20 bp, Artificial sequence
  Synthetic oligonucleotide
actggttgaacccactgcat

SEQ ID NO: 2294 - DNA, 20 bp, Artificial sequence
  Synthetic oligonucleotide
tcaagactggttgaacccac

SEQ ID NO: 2295 - DNA, 20 bp, Artificial sequence
  Synthetic oligonucleotide
tgggatcaagactggttgaa

SEQ ID NO: 2296 - DNA, 20 bp, Artificial sequence
  Synthetic oligonucleotide
gcagatgggatcaagactgg

SEQ ID NO: 2297 - DNA, 20 bp, Artificial sequence
  Synthetic oligonucleotide
aagctgcagatgggatcaag

SEQ ID NO: 2298 - DNA, 20 bp, Artificial sequence
  Synthetic oligonucleotide
gtgctaagctgcagatggga

SEQ ID NO: 2299 - DNA, 20 bp, Artificial sequence
  Synthetic oligonucleotide
gcatgtgaagggacccaccc

SEQ ID NO: 2300 - DNA, 20 bp, Artificial sequence
  Synthetic oligonucleotide
tgaaaagactgaggcccagg

SEQ ID NO: 2301 - DNA, 20 bp, Artificial sequence
  Synthetic oligonucleotide
acagatgaaaagactgaggc

SEQ ID NO: 2302 - DNA, 20 bp, Artificial sequence
  Synthetic oligonucleotide
ctattacagatgaaaagact

SEQ ID NO: 2303 - DNA, 20 bp, Artificial sequence
  Synthetic oligonucleotide
gtcccctattacagatgaaa

SEQ ID NO: 2304 - DNA, 20 bp, Artificial sequence
  Synthetic oligonucleotide
tggttgtcccctattacaga

SEQ ID NO: 2305 - DNA, 20 bp, Artificial sequence
  Synthetic oligonucleotide
atctctggttgtcccctatt

SEQ ID NO: 2306 - DNA, 20 bp, Artificial sequence
  Synthetic oligonucleotide
gctgcatctctggttgtccc

SEQ ID NO: 2307 - DNA, 20 bp, Artificial sequence
  Synthetic oligonucleotide
tatgtgctgcatctctggtt

SEQ ID NO: 2308 - DNA, 20 bp, Artificial sequence
  Synthetic oligonucleotide
tctcactttcatttattttc

SEQ ID NO: 2309 - DNA, 20 bp, Artificial sequence
  Synthetic oligonucleotide
gcttcaggcagcctgaagga

SEQ ID NO: 2310 - DNA, 20 bp, Artificial sequence
  Synthetic oligonucleotide
agtgagcttcaggcagcctg

SEQ ID NO: 2311 - DNA, 20 bp, Artificial sequence
  Synthetic oligonucleotide
gcttccccaaagggcccagt

SEQ ID NO: 2312 - DNA, 20 bp, Artificial sequence
  Synthetic oligonucleotide
cctttgcttccccaaagggc

SEQ ID NO: 2313 - DNA, 20 bp, Artificial sequence
  Synthetic oligonucleotide
cctcatctcagtgcccaaag

SEQ ID NO: 2314 - DNA, 20 bp, Artificial sequence
  Synthetic oligonucleotide
agcatccccaatccctgctc

SEQ ID NO: 2315 - DNA, 20 bp, Artificial sequence
  Synthetic oligonucleotide
ctttgagcatccccaatccc

SEQ ID NO: 2316 - DNA, 20 bp, Artificial sequence
  Synthetic oligonucleotide
gtgtactttgagcatcccca

SEQ ID NO: 2317 - DNA, 20 bp, Artificial sequence
  Synthetic oligonucleotide
tccaagtgtactttgagcat

SEQ ID NO: 2318 - DNA, 20 bp, Artificial sequence
  Synthetic oligonucleotide
agaggttcaacatccaattt

SEQ ID NO: 2319 - DNA, 20 bp, Artificial sequence
  Synthetic oligonucleotide
aaggacagaggttcaacatc

SEQ ID NO: 2320 - DNA, 20 bp, Artificial sequence
  Synthetic oligonucleotide
aggccaaggacagaggttca

SEQ ID NO: 2321 - DNA, 20 bp, Artificial sequence
  Synthetic oligonucleotide
ctgtgaggccaaggacagag

SEQ ID NO: 2322 - DNA, 20 bp, Artificial sequence
  Synthetic oligonucleotide
tctgtctgtgaggccaagga

SEQ ID NO: 2323 - DNA, 20 bp, Artificial sequence
  Synthetic oligonucleotide
tgctatctgtctgtgaggcc

SEQ ID NO: 2324 - DNA, 20 bp, Artificial sequence
  Synthetic oligonucleotide
gtctctcataattgccagtt

SEQ ID NO: 2325 - DNA, 20 bp, Artificial sequence
  Synthetic oligonucleotide
gggaagtctctcataattgc

SEQ ID NO: 2326 - DNA, 20 bp, Artificial sequence
  Synthetic oligonucleotide
gccttgggaagtctctcata

SEQ ID NO: 2327 - DNA, 20 bp, Artificial sequence
  Synthetic oligonucleotide
gctaggccttgggaagtctc

SEQ ID NO: 2328 - DNA, 20 bp, Artificial sequence
  Synthetic oligonucleotide
tgaagtatctaaagaggcta

SEQ ID NO: 2329 - DNA, 20 bp, Artificial sequence
  Synthetic oligonucleotide
ccacatgaagtatctaaaga

SEQ ID NO: 2330 - DNA, 20 bp, Artificial sequence
  Synthetic oligonucleotide
ggagaccacatgaagtatct

SEQ ID NO: 2331 - DNA, 20 bp, Artificial sequence
  Synthetic oligonucleotide
attttggagaccacatgaag

SEQ ID NO: 2332 - DNA, 20 bp, Artificial sequence
  Synthetic oligonucleotide
gggtcattttggagaccaca

SEQ ID NO: 2333 - DNA, 20 bp, Artificial sequence
  Synthetic oligonucleotide
atgggaatggtatcgcactc

SEQ ID NO: 2334 - DNA, 20 bp, Artificial sequence
  Synthetic oligonucleotide
acacaatgggaatggtatcg

SEQ ID NO: 2335 - DNA, 20 bp, Artificial sequence
  Synthetic oligonucleotide
cccctgtgccctggtttcta

SEQ ID NO: 2336 - DNA, 20 bp, Artificial sequence
  Synthetic oligonucleotide
atgctcccctgtgccctggt

SEQ ID NO: 2337 - DNA, 20 bp, Artificial sequence
  Synthetic oligonucleotide
tctgcatgctcccctgtgcc

SEQ ID NO: 2338 - DNA, 20 bp, Artificial sequence
  Synthetic oligonucleotide
ggctgtctgcatgctcccct

SEQ ID NO: 2339 - DNA, 20 bp, Artificial sequence
  Synthetic oligonucleotide
ctatagaatcagacagacct

SEQ ID NO: 2340 - DNA, 20 bp, Artificial sequence
  Synthetic oligonucleotide
atcagctatagaatcagaca

SEQ ID NO: 2341 - DNA, 20 bp, Artificial sequence
  Synthetic oligonucleotide
caaacctcacctcccacagg

SEQ ID NO: 2342 - DNA, 20 bp, Artificial sequence
  Synthetic oligonucleotide
cagtacaaacctcacctccc

SEQ ID NO: 2343 - DNA, 20 bp, Artificial sequence
  Synthetic oligonucleotide
tcagtccactgtcacccttc

SEQ ID NO: 2344 - DNA, 20 bp, Artificial sequence
  Synthetic oligonucleotide
agatgtcagtccactgtcac

SEQ ID NO: 2345 - DNA, 20 bp, Artificial sequence
  Synthetic oligonucleotide
agggaagatgtcagtccact

SEQ ID NO: 2346 - DNA, 20 bp, Artificial sequence
  Synthetic oligonucleotide
agcagagggaagatgtcagt

SEQ ID NO: 2347 - DNA, 20 bp, Artificial sequence
  Synthetic oligonucleotide
gcctacagcagagggaagat

SEQ ID NO: 2348 - DNA, 20 bp, Artificial sequence
  Synthetic oligonucleotide
ccagtgcctacagcagaggg

SEQ ID NO: 2349 - DNA, 20 bp, Artificial sequence
  Synthetic oligonucleotide
tggatccagtgcctacagca

SEQ ID NO: 2350 - DNA, 20 bp, Artificial sequence
  Synthetic oligonucleotide
ggatgctggatccagtgcct

SEQ ID NO: 2351 - DNA, 20 bp, Artificial sequence
  Synthetic oligonucleotide
acccagtacaaggaaggaca

SEQ ID NO: 2352 - DNA, 20 bp, Artificial sequence
  Synthetic oligonucleotide
agcttacccagtacaaggaa

SEQ ID NO: 2353 - DNA, 20 bp, Artificial sequence
  Synthetic oligonucleotide
ggcccagcttacccagtaca

SEQ ID NO: 2354 - DNA, 20 bp, Artificial sequence
  Synthetic oligonucleotide
ctcttattccctcacccctg

SEQ ID NO: 2355 - DNA, 20 bp, Artificial sequence
  Synthetic oligonucleotide
cacttgatctgggacccaaa

SEQ ID NO: 2356 - DNA, 20 bp, Artificial sequence
  Synthetic oligonucleotide
tagagcacttgatctgggac

SEQ ID NO: 2357 - DNA, 20 bp, Artificial sequence
  Synthetic oligonucleotide
actatcacaccacctcccac

SEQ ID NO: 2358 - DNA, 20 bp, Artificial sequence
  Synthetic oligonucleotide
tgggaactatcacaccacct

SEQ ID NO: 2359 - DNA, 20 bp, Artificial sequence
  Synthetic oligonucleotide
gtaaatgggaactatcacac

SEQ ID NO: 2360 - DNA, 20 bp, Artificial sequence
  Synthetic oligonucleotide
catctgtaaatgggaactat

SEQ ID NO: 2361 - DNA, 20 bp, Artificial sequence
  Synthetic oligonucleotide
tttcccatctgtaaatggga

SEQ ID NO: 2362 - DNA, 20 bp, Artificial sequence
  Synthetic oligonucleotide
tgaggtttcccatctgtaaa

SEQ ID NO: 2363 - DNA, 20 bp, Artificial sequence
  Synthetic oligonucleotide
gaccttgggcaagttaccta

SEQ ID NO: 2364 - DNA, 20 bp, Artificial sequence
  Synthetic oligonucleotide
tgtgtgaccttgggcaagtt

SEQ ID NO: 2365 - DNA, 20 bp, Artificial sequence
  Synthetic oligonucleotide
aaatctgtgtgaccttgggc

SEQ ID NO: 2366 - DNA, 20 bp, Artificial sequence
  Synthetic oligonucleotide
gattcaaatctgtgtgacct

SEQ ID NO: 2367 - DNA, 20 bp, Artificial sequence
  Synthetic oligonucleotide
acagggattcaaatctgtgt

SEQ ID NO: 2368 - DNA, 20 bp, Artificial sequence
  Synthetic oligonucleotide
ggaaaggcacaggctttggg

SEQ ID NO: 2369 - DNA, 20 bp, Artificial sequence
  Synthetic oligonucleotide
aatgtctgttggtgggcagg

SEQ ID NO: 2370 - DNA, 20 bp, Artificial sequence
  Synthetic oligonucleotide
ggcaaagtaacatacctgct

SEQ ID NO: 2371 - DNA, 20 bp, Artificial sequence
  Synthetic oligonucleotide
cttaaggcaaagtaacatac

SEQ ID NO: 2372 - DNA, 20 bp, Artificial sequence
  Synthetic oligonucleotide
tgtaaggtcacagagcttgt

SEQ ID NO: 2373 - DNA, 20 bp, Artificial sequence
  Synthetic oligonucleotide
ggaaactaacactcagagag

SEQ ID NO: 2374 - DNA, 20 bp, Artificial sequence
  Synthetic oligonucleotide
aatgaggaaactaacactca

SEQ ID NO: 2375 - DNA, 20 bp, Artificial sequence
  Synthetic oligonucleotide
tttcttatcttcaatcctca

SEQ ID NO: 2376 - DNA, 20 bp, Artificial sequence
  Synthetic oligonucleotide
tctcatttcttatcttcaat

SEQ ID NO: 2377 - DNA, 20 bp, Artificial sequence
  Synthetic oligonucleotide
ggtgctctcatttcttatct

SEQ ID NO: 2378 - DNA, 20 bp, Artificial sequence
  Synthetic oligonucleotide
cccatcatgaccaggccctg

SEQ ID NO: 2379 - DNA, 20 bp, Artificial sequence
  Synthetic oligonucleotide
aggcctcgggaagcacctgg

SEQ ID NO: 2380 - DNA, 20 bp, Artificial sequence
  Synthetic oligonucleotide
ggagcaggcctcgggaagca

SEQ ID NO: 2381 - DNA, 20 bp, Artificial sequence
  Synthetic oligonucleotide
atgtgggctgtgctgagaga

SEQ ID NO: 2382 - DNA, 20 bp, Artificial sequence
  Synthetic oligonucleotide
agaaaaagcaaccaaagcac

SEQ ID NO: 2383 - DNA, 20 bp, Artificial sequence
  Synthetic oligonucleotide
cctgcagaaaaagcaaccaa

SEQ ID NO: 2384 - DNA, 20 bp, Artificial sequence
  Synthetic oligonucleotide
ccagacctgcagaaaaagca

SEQ ID NO: 2385 - DNA, 20 bp, Artificial sequence
  Synthetic oligonucleotide
cctaaggagtgagggtatct

SEQ ID NO: 2386 - DNA, 20 bp, Artificial sequence
  Synthetic oligonucleotide
ctctgagtgcaaaggctctg

SEQ ID NO: 2387 - DNA, 20 bp, Artificial sequence
  Synthetic oligonucleotide
agcagctctgagtgcaaagg

SEQ ID NO: 2388 - DNA, 20 bp, Artificial sequence
  Synthetic oligonucleotide
cccagagcagctctgagtgc

SEQ ID NO: 2389 - DNA, 20 bp, Artificial sequence
  Synthetic oligonucleotide
ctttccccagagcagctctg

SEQ ID NO: 2390 - DNA, 20 bp, Artificial sequence
  Synthetic oligonucleotide
tgaccctgcttagaggacct

SEQ ID NO: 2391 - DNA, 20 bp, Artificial sequence
  Synthetic oligonucleotide
attcctgaccctgcttagag

SEQ ID NO: 2392 - DNA, 20 bp, Artificial sequence
  Synthetic oligonucleotide
ccagcattcctgaccctgct

SEQ ID NO: 2393 - DNA, 20 bp, Artificial sequence
  Synthetic oligonucleotide
gaaacccagcattcctgacc

SEQ ID NO: 2394 - DNA, 20 bp, Artificial sequence
  Synthetic oligonucleotide
ggactgaaacccagcattcc

SEQ ID NO: 2395 - DNA, 20 bp, Artificial sequence
  Synthetic oligonucleotide
agccaggactgaaacccagc

SEQ ID NO: 2396 - DNA, 20 bp, Artificial sequence
  Synthetic oligonucleotide
ggcagagccaggactgaaac

SEQ ID NO: 2397 - DNA, 20 bp, Artificial sequence
  Synthetic oligonucleotide
taggcggcagagccaggact

SEQ ID NO: 2398 - DNA, 20 bp, Artificial sequence
  Synthetic oligonucleotide
ggcagtaggcggcagagcca

SEQ ID NO: 2399 - DNA, 20 bp, Artificial sequence
  Synthetic oligonucleotide
accagagacaggcactgact

SEQ ID NO: 2400 - DNA, 20 bp, Artificial sequence
  Synthetic oligonucleotide
tggacagccagggagactgg

SEQ ID NO: 2401 - DNA, 20 bp, Artificial sequence
  Synthetic oligonucleotide
ctaattggacagccagggag

SEQ ID NO: 2402 - DNA, 20 bp, Artificial sequence
  Synthetic oligonucleotide
atagcctaattggacagcca

SEQ ID NO: 2403 - DNA, 20 bp, Artificial sequence
  Synthetic oligonucleotide
ccagtatagcctaattggac

SEQ ID NO: 2404 - DNA, 20 bp, Artificial sequence
  Synthetic oligonucleotide
ggtcatccagtatagcctaa

SEQ ID NO: 2405 - DNA, 20 bp, Artificial sequence
  Synthetic oligonucleotide
gacttgcccagcaacccatc

SEQ ID NO: 2406 - DNA, 20 bp, Artificial sequence
  Synthetic oligonucleotide
ctccagacttgcccagcaac

SEQ ID NO: 2407 - DNA, 20 bp, Artificial sequence
  Synthetic oligonucleotide
cccacctccagacttgccca

SEQ ID NO: 2408 - DNA, 20 bp, Artificial sequence
  Synthetic oligonucleotide
actttcccacctccagactt

SEQ ID NO: 2409 - DNA, 20 bp, Artificial sequence
  Synthetic oligonucleotide
ataggactttcccacctcca

SEQ ID NO: 2410 - DNA, 20 bp, Artificial sequence
  Synthetic oligonucleotide
ccttcataggactttcccac

SEQ ID NO: 2411 - DNA, 20 bp, Artificial sequence
  Synthetic oligonucleotide
tcctaccttcataggacttt

SEQ ID NO: 2412 - DNA, 20 bp, Artificial sequence
  Synthetic oligonucleotide
aaaaatcctaccttcatagg

SEQ ID NO: 2413 - DNA, 20 bp, Artificial sequence
  Synthetic oligonucleotide
tgcctcataattgctccttc

SEQ ID NO: 2414 - DNA, 20 bp, Artificial sequence
  Synthetic oligonucleotide
aggtctgcctcataattgct

SEQ ID NO: 2415 - DNA, 20 bp, Artificial sequence
  Synthetic oligonucleotide
tccagaggtctgcctcataa

SEQ ID NO: 2416 - DNA, 20 bp, Artificial sequence
  Synthetic oligonucleotide
ataaagaggctgggccatag

SEQ ID NO: 2417 - DNA, 20 bp, Artificial sequence
  Synthetic oligonucleotide
caggatgtgaactcacaaaa

SEQ ID NO: 2418 - DNA, 20 bp, Artificial sequence
  Synthetic oligonucleotide
gtagcatctaataacaccac

SEQ ID NO: 2419 - DNA, 20 bp, Artificial sequence
  Synthetic oligonucleotide
gttcagtagcatctaataac

SEQ ID NO: 2420 - DNA, 20 bp, Artificial sequence
  Synthetic oligonucleotide
tgggtgttcagtagcatcta

SEQ ID NO: 2421 - DNA, 20 bp, Artificial sequence
  Synthetic oligonucleotide
tatgtgaccccaggcaagct

SEQ ID NO: 2422 - DNA, 20 bp, Artificial sequence
  Synthetic oligonucleotide
ctcactatgtgaccccaggc

SEQ ID NO: 2423 - DNA, 20 bp, Artificial sequence
  Synthetic oligonucleotide
ttctactcactatgtgaccc

SEQ ID NO: 2424 - DNA, 20 bp, Artificial sequence
  Synthetic oligonucleotide
tttggttctactcactatgt

SEQ ID NO: 2425 - DNA, 20 bp, Artificial sequence
  Synthetic oligonucleotide
cagactttggttctactcac

SEQ ID NO: 2426 - DNA, 20 bp, Artificial sequence
  Synthetic oligonucleotide
aggttcagactttggttcta

SEQ ID NO: 2427 - DNA, 20 bp, Artificial sequence
  Synthetic oligonucleotide
aacctaggttcagactttgg

SEQ ID NO: 2428 - DNA, 20 bp, Artificial sequence
  Synthetic oligonucleotide
agtcaaacctaggttcagac

SEQ ID NO: 2429 - DNA, 20 bp, Artificial sequence
  Synthetic oligonucleotide
agaagagtcaaacctaggtt

SEQ ID NO: 2430 - DNA, 20 bp, Artificial sequence
  Synthetic oligonucleotide
ttagcagaagagtcaaacct

SEQ ID NO: 2431 - DNA, 20 bp, Artificial sequence
  Synthetic oligonucleotide
ttagtttagcagaagagtca

SEQ ID NO: 2432 - DNA, 20 bp, Artificial sequence
  Synthetic oligonucleotide
gtgtgatgcatcagagggaa

SEQ ID NO: 2433 - DNA, 20 bp, Artificial sequence
  Synthetic oligonucleotide
ccctggtgtgatgcatcaga

SEQ ID NO: 2434 - DNA, 20 bp, Artificial sequence
  Synthetic oligonucleotide
cctttccctggtgtgatgca

SEQ ID NO: 2435 - DNA, 20 bp, Artificial sequence
  Synthetic oligonucleotide
aaatgctaggcctcaagatg

SEQ ID NO: 2436 - DNA, 20 bp, Artificial sequence
  Synthetic oligonucleotide
gaaggaaatgctaggcctca

SEQ ID NO: 2437 - DNA, 20 bp, Artificial sequence
  Synthetic oligonucleotide
ggaaggaaggaaatgctagg

SEQ ID NO: 2438 - DNA, 20 bp, Artificial sequence
  Synthetic oligonucleotide
taggaggaaggaaggaaatg

SEQ ID NO: 2439 - DNA, 20 bp, Artificial sequence
  Synthetic oligonucleotide
acttttaggaggaaggaagg

SEQ ID NO: 2440 - DNA, 20 bp, Artificial sequence
  Synthetic oligonucleotide
ctttgacttttaggaggaag

SEQ ID NO: 2441 - DNA, 20 bp, Artificial sequence
  Synthetic oligonucleotide
aactgctttgacttttagga

SEQ ID NO: 2442 - DNA, 20 bp, Artificial sequence
  Synthetic oligonucleotide
ttaacaactgctttgacttt

SEQ ID NO: 2443 - DNA, 20 bp, Artificial sequence
  Synthetic oligonucleotide
gaaagttaacaactgctttg

SEQ ID NO: 2444 - DNA, 20 bp, Artificial sequence
  Synthetic oligonucleotide
taccatctgctctgtgaaag

SEQ ID NO: 2445 - DNA, 20 bp, Artificial sequence
  Synthetic oligonucleotide
cttcataccatctgctctgt

SEQ ID NO: 2446 - DNA, 20 bp, Artificial sequence
  Synthetic oligonucleotide
caagcacctactgtgtgccc

SEQ ID NO: 2447 - DNA, 20 bp, Artificial sequence
  Synthetic oligonucleotide
ttcaccaagcacctactgtg

SEQ ID NO: 2448 - DNA, 20 bp, Artificial sequence
  Synthetic oligonucleotide
acatcttcaccaagcaccta

SEQ ID NO: 2449 - DNA, 20 bp, Artificial sequence
  Synthetic oligonucleotide
ccactacatgccctttgctc

SEQ ID NO: 2450 - DNA, 20 bp, Artificial sequence
  Synthetic oligonucleotide
ctgaagaagtgggccacctc

SEQ ID NO: 2451 - DNA, 20 bp, Artificial sequence
  Synthetic oligonucleotide
acccataccccattccttcc

SEQ ID NO: 2452 - DNA, 20 bp, Artificial sequence
  Synthetic oligonucleotide
tcctcacccataccccattc

SEQ ID NO: 2453 - DNA, 20 bp, Artificial sequence
  Synthetic oligonucleotide
agcctggtgactgcaggaga

SEQ ID NO: 2454 - DNA, 20 bp, Artificial sequence
  Synthetic oligonucleotide
caggaagcctggtgactgca

SEQ ID NO: 2455 - DNA, 20 bp, Artificial sequence
  Synthetic oligonucleotide
tccagcagctgatgggcagt

SEQ ID NO: 2456 - DNA, 20 bp, Artificial sequence
  Synthetic oligonucleotide
tggactccagcagctgatgg

SEQ ID NO: 2457 - DNA, 20 bp, Artificial sequence
  Synthetic oligonucleotide
cttggtgcccctaggatgac

SEQ ID NO: 2458 - DNA, 20 bp, Artificial sequence
  Synthetic oligonucleotide
attggcttggtgcccctagg

SEQ ID NO: 2459 - DNA, 20 bp, Artificial sequence
  Synthetic oligonucleotide
acttaattggcttggtgccc

SEQ ID NO: 2460 - DNA, 20 bp, Artificial sequence
  Synthetic oligonucleotide
cactgagggctgtaattatg

SEQ ID NO: 2461 - DNA, 20 bp, Artificial sequence
  Synthetic oligonucleotide
aaggacactgagggctgtaa

SEQ ID NO: 2462 - DNA, 20 bp, Artificial sequence
  Synthetic oligonucleotide
gcctgaaggacactgagggc

SEQ ID NO: 2463 - DNA, 20 bp, Artificial sequence
  Synthetic oligonucleotide
aggcagcctgaaggacactg

SEQ ID NO: 2464 - DNA, 20 bp, Artificial sequence
  Synthetic oligonucleotide
tgttcctgactcctgggtgg

SEQ ID NO: 2465 - DNA, 20 bp, Artificial sequence
  Synthetic oligonucleotide
ctgactgttcctgactcctg

SEQ ID NO: 2466 - DNA, 20 bp, Artificial sequence
  Synthetic oligonucleotide
tgctgcaatcagatgccacc

SEQ ID NO: 2467 - DNA, 20 bp, Artificial sequence
  Synthetic oligonucleotide
gccgatgctgcaatcagatg

SEQ ID NO: 2468 - DNA, 20 bp, Artificial sequence
  Synthetic oligonucleotide
gggatgccgatgctgcaatc

SEQ ID NO: 2469 - DNA, 20 bp, Artificial sequence
  Synthetic oligonucleotide
gtccagcagaagctggtggg

SEQ ID NO: 2470 - DNA, 20 bp, Artificial sequence
  Synthetic oligonucleotide
gaggagtccagcagaagctg

SEQ ID NO: 2471 - DNA, 20 bp, Artificial sequence
  Synthetic oligonucleotide
gctgggaggagtccagcaga

SEQ ID NO: 2472 - DNA, 20 bp, Artificial sequence
  Synthetic oligonucleotide
ctgtggctgggaggagtcca

SEQ ID NO: 2473 - DNA, 20 bp, Artificial sequence
  Synthetic oligonucleotide
cccagctgtggctgggagga

SEQ ID NO: 2474 - DNA, 20 bp, Artificial sequence
  Synthetic oligonucleotide
tctgccccagctgtggctgg

SEQ ID NO: 2475 - DNA, 20 bp, Artificial sequence
  Synthetic oligonucleotide
cttcctctgccccagctgtg

SEQ ID NO: 2476 - DNA, 20 bp, Artificial sequence
  Synthetic oligonucleotide
cagtacttcctctgccccag

SEQ ID NO: 2477 - DNA, 20 bp, Artificial sequence
  Synthetic oligonucleotide
gctgtcagtacttcctctgc

SEQ ID NO: 2478 - DNA, 20 bp, Artificial sequence
  Synthetic oligonucleotide
acctggctgtcagtacttcc

SEQ ID NO: 2479 - DNA, 20 bp, Artificial sequence
  Synthetic oligonucleotide
ttgccacctggctgtcagta

SEQ ID NO: 2480 - DNA, 20 bp, Artificial sequence
  Synthetic oligonucleotide
agtccttgccacctggctgt

SEQ ID NO: 2481 - DNA, 20 bp, Artificial sequence
  Synthetic oligonucleotide
ctgccagtccttgccacctg

SEQ ID NO: 2482 - DNA, 20 bp, Artificial sequence
  Synthetic oligonucleotide
aaacactgccagtccttgcc

SEQ ID NO: 2483 - DNA, 20 bp, Artificial sequence
  Synthetic oligonucleotide
ggaagtgagggttcagttgg

SEQ ID NO: 2484 - DNA, 20 bp, Artificial sequence
  Synthetic oligonucleotide
ctctctgggcttcagtttcc

SEQ ID NO: 2485 - DNA, 20 bp, Artificial sequence
  Synthetic oligonucleotide
ctcacctctctgggcttcag

SEQ ID NO: 2486 - DNA, 20 bp, Artificial sequence
  Synthetic oligonucleotide
gtctcctcacctctctgggc

SEQ ID NO: 2487 - DNA, 20 bp, Artificial sequence
  Synthetic oligonucleotide
gctaagtctcctcacctctc

SEQ ID NO: 2488 - DNA, 20 bp, Artificial sequence
  Synthetic oligonucleotide
atctgttttccttcagaggg

SEQ ID NO: 2489 - DNA, 20 bp, Artificial sequence
  Synthetic oligonucleotide
ttccttctctctgctcccca

SEQ ID NO: 2490 - DNA, 20 bp, Artificial sequence
  Synthetic oligonucleotide
ccaagttccttctctctgct

SEQ ID NO: 2491 - DNA, 20 bp, Artificial sequence
  Synthetic oligonucleotide
tgtccccaagttccttctct

SEQ ID NO: 2492 - DNA, 20 bp, Artificial sequence
  Synthetic oligonucleotide
ggtcaaggtcactcagccag

SEQ ID NO: 2493 - DNA, 20 bp, Artificial sequence
  Synthetic oligonucleotide
ccctattttgatggtgatac

SEQ ID NO: 2494 - DNA, 20 bp, Artificial sequence
  Synthetic oligonucleotide
tggactcctgtgagtttggc

SEQ ID NO: 2495 - DNA, 20 bp, Artificial sequence
  Synthetic oligonucleotide
gcacttggactcctgtgagt

SEQ ID NO: 2496 - DNA, 20 bp, Artificial sequence
  Synthetic oligonucleotide
cacaggcacttggactcctg

SEQ ID NO: 2497 - DNA, 20 bp, Artificial sequence
  Synthetic oligonucleotide
ccttgcacaggcacttggac

SEQ ID NO: 2498 - DNA, 20 bp, Artificial sequence
  Synthetic oligonucleotide
catgcccttgcacaggcact

SEQ ID NO: 2499 - DNA, 20 bp, Artificial sequence
  Synthetic oligonucleotide
ccctccatgcccttgcacag

SEQ ID NO: 2500 - DNA, 20 bp, Artificial sequence
  Synthetic oligonucleotide
aggcccataaagctttggga

SEQ ID NO: 2501 - DNA, 20 bp, Artificial sequence
  Synthetic oligonucleotide
acaagaggcccataaagctt

SEQ ID NO: 2502 - DNA, 20 bp, Artificial sequence
  Synthetic oligonucleotide
gatgcacaagaggcccataa

SEQ ID NO: 2503 - DNA, 20 bp, Artificial sequence
  Synthetic oligonucleotide
ggtatgatgcacaagaggcc

SEQ ID NO: 2504 - DNA, 20 bp, Artificial sequence
  Synthetic oligonucleotide
ctggccactcttcaggcccc

SEQ ID NO: 2505 - DNA, 20 bp, Artificial sequence
  Synthetic oligonucleotide
gtgctctggccactcttcag

SEQ ID NO: 2506 - DNA, 20 bp, Artificial sequence
  Synthetic oligonucleotide
gatccatatctggatcccca

SEQ ID NO: 2507 - DNA, 20 bp, Artificial sequence
  Synthetic oligonucleotide
ggtctgatccatatctggat

SEQ ID NO: 2508 - DNA, 20 bp, Artificial sequence
  Synthetic oligonucleotide
gctgattacaagctgattct

SEQ ID NO: 2509 - DNA, 20 bp, Artificial sequence
  Synthetic oligonucleotide
taactgctgattacaagctg

SEQ ID NO: 2510 - DNA, 20 bp, Artificial sequence
  Synthetic oligonucleotide
acaatggagaaacaaaagag

SEQ ID NO: 2511 - DNA, 20 bp, Artificial sequence
  Synthetic oligonucleotide
tttgaagataaagtcagacc

SEQ ID NO: 2512 - DNA, 20 bp, Artificial sequence
  Synthetic oligonucleotide
gtctatgcaggcctggaatt

SEQ ID NO: 2513 - DNA, 20 bp, Artificial sequence
  Synthetic oligonucleotide
ctaaggtctatgcaggcctg

SEQ ID NO: 2514 - DNA, 20 bp, Artificial sequence
  Synthetic oligonucleotide
aaacactaaggtctatgcag

SEQ ID NO: 2515 - DNA, 20 bp, Artificial sequence
  Synthetic oligonucleotide
atgataaacactaaggtcta

SEQ ID NO: 2516 - DNA, 20 bp, Artificial sequence
  Synthetic oligonucleotide
ctgggatgataaacactaag

SEQ ID NO: 2517 - DNA, 20 bp, Artificial sequence
  Synthetic oligonucleotide
cttctctgggatgataaaca

SEQ ID NO: 2518 - DNA, 20 bp, Artificial sequence
  Synthetic oligonucleotide
ctttccttctctgggatgat

SEQ ID NO: 2519 - DNA, 20 bp, Artificial sequence
  Synthetic oligonucleotide
aagcctttggaaagagaagg

SEQ ID NO: 2520 - DNA, 20 bp, Artificial sequence
  Synthetic oligonucleotide
ccaggaagcctttggaaaga

SEQ ID NO: 2521 - DNA, 20 bp, Artificial sequence
  Synthetic oligonucleotide
gtcttccaggaagcctttgg

SEQ ID NO: 2522 - DNA, 20 bp, Artificial sequence
  Synthetic oligonucleotide
cagcagtcttccaggaagcc

SEQ ID NO: 2523 - DNA, 20 bp, Artificial sequence
  Synthetic oligonucleotide
taaggcagcagtcttccagg

SEQ ID NO: 2524 - DNA, 20 bp, Artificial sequence
  Synthetic oligonucleotide
ggtgataaggcagcagtctt

SEQ ID NO: 2525 - DNA, 20 bp, Artificial sequence
  Synthetic oligonucleotide
gagatggtgataaggcagca

SEQ ID NO: 2526 - DNA, 20 bp, Artificial sequence
  Synthetic oligonucleotide
aacccagagatggtgataag

SEQ ID NO: 2527 - DNA, 20 bp, Artificial sequence
  Synthetic oligonucleotide
ttcaaaacccagagatggtg

SEQ ID NO: 2528 - DNA, 20 bp, Artificial sequence
  Synthetic oligonucleotide
catccttcaaaacccagaga

SEQ ID NO: 2529 - DNA, 20 bp, Artificial sequence
  Synthetic oligonucleotide
ctgataatgagataaagcaa

SEQ ID NO: 2530 - DNA, 20 bp, Artificial sequence
  Synthetic oligonucleotide
cagaggcccttccctgcttt

SEQ ID NO: 2531 - DNA, 20 bp, Artificial sequence
  Synthetic oligonucleotide
tgggagcccccagtccacct

SEQ ID NO: 2532 - DNA, 20 bp, Artificial sequence
  Synthetic oligonucleotide
gccagtgggagcccccagtc

SEQ ID NO: 2533 - DNA, 20 bp, Artificial sequence
  Synthetic oligonucleotide
tggcctgggagctggcctgg

SEQ ID NO: 2534 - DNA, 20 bp, Artificial sequence
  Synthetic oligonucleotide
ctctcaggcaatcccaacct

SEQ ID NO: 2535 - DNA, 20 bp, Artificial sequence
  Synthetic oligonucleotide
aggccctctcaggcaatccc

SEQ ID NO: 2536 - DNA, 20 bp, Artificial sequence
  Synthetic oligonucleotide
ggcccaggccctctcaggca

SEQ ID NO: 2537 - DNA, 20 bp, Artificial sequence
  Synthetic oligonucleotide
tctcaggcccaggccctctc

SEQ ID NO: 2538 - DNA, 20 bp, Artificial sequence
  Synthetic oligonucleotide
ctcctggagagggaagctgg

SEQ ID NO: 2539 - DNA, 20 bp, Artificial sequence
  Synthetic oligonucleotide
ggaggctcctggagagggaa

SEQ ID NO: 2540 - DNA, 20 bp, Artificial sequence
  Synthetic oligonucleotide
agttgggaggctcctggaga

SEQ ID NO: 2541 - DNA, 20 bp, Artificial sequence
  Synthetic oligonucleotide
gctggaacaaagccttgcag

SEQ ID NO: 2542 - DNA, 20 bp, Artificial sequence
  Synthetic oligonucleotide
aagaagaggtcgcagagtga

SEQ ID NO: 2543 - DNA, 20 bp, Artificial sequence
  Synthetic oligonucleotide
gctactggcattgctcctcc

SEQ ID NO: 2544 - DNA, 20 bp, Artificial sequence
  Synthetic oligonucleotide
acatgtggcatttgttaggt

SEQ ID NO: 2545 - DNA, 20 bp, Artificial sequence
  Synthetic oligonucleotide
ggaacattaaattttaaaac

SEQ ID NO: 2546 - DNA, 20 bp, Artificial sequence
  Synthetic oligonucleotide
taggatgagggtgataatcc

SEQ ID NO: 2547 - DNA, 20 bp, Artificial sequence
  Synthetic oligonucleotide
cctaactctagctttggttt

SEQ ID NO: 2548 - DNA, 20 bp, Artificial sequence
  Synthetic oligonucleotide
agtcacctaactctagcttt

SEQ ID NO: 2549 - DNA, 20 bp, Artificial sequence
  Synthetic oligonucleotide
gccctgggccagctctgccc

SEQ ID NO: 2550 - DNA, 20 bp, Artificial sequence
  Synthetic oligonucleotide
tctgagaaagagggccctgg

SEQ ID NO: 2551 - DNA, 20 bp, Artificial sequence
  Synthetic oligonucleotide
ctaaatctgagaaagagggc

SEQ ID NO: 2552 - DNA, 20 bp, Artificial sequence
  Synthetic oligonucleotide
ctgagggcagcagtgtctga

SEQ ID NO: 2553 - DNA, 20 bp, Artificial sequence
  Synthetic oligonucleotide
catgcctgagggcagcagtg

SEQ ID NO: 2554 - DNA, 20 bp, Artificial sequence
  Synthetic oligonucleotide
tctcacatgcctgagggcag

SEQ ID NO: 2555 - DNA, 20 bp, Artificial sequence
  Synthetic oligonucleotide
caggaaggccacacctcggg

SEQ ID NO: 2556 - DNA, 20 bp, Artificial sequence
  Synthetic oligonucleotide
gtgaccaggaaggccacacc

SEQ ID NO: 2557 - DNA, 20 bp, Artificial sequence
  Synthetic oligonucleotide
tcaaagtgaccaggaaggcc

SEQ ID NO: 2558 - DNA, 20 bp, Artificial sequence
  Synthetic oligonucleotide
tgatatcaaagtgaccagga

SEQ ID NO: 2559 - DNA, 20 bp, Artificial sequence
  Synthetic oligonucleotide
atatctgatatcaaagtgac

SEQ ID NO: 2560 - DNA, 20 bp, Artificial sequence
  Synthetic oligonucleotide
gcccaatatctgatatcaaa

SEQ ID NO: 2561 - DNA, 20 bp, Artificial sequence
  Synthetic oligonucleotide
gacccagggcccagcccagg

SEQ ID NO: 2562 - DNA, 20 bp, Artificial sequence
  Synthetic oligonucleotide
tctcagacccagggcccagc

SEQ ID NO: 2563 - DNA, 20 bp, Artificial sequence
  Synthetic oligonucleotide
tgagactggattccaccccc

SEQ ID NO: 2564 - DNA, 20 bp, Artificial sequence
  Synthetic oligonucleotide
tacaatgctacgctgttgag

SEQ ID NO: 2565 - DNA, 20 bp, Artificial sequence
  Synthetic oligonucleotide
atctctacaatgctacgctg

SEQ ID NO: 2566 - DNA, 20 bp, Artificial sequence
  Synthetic oligonucleotide
tcatcatctctacaatgcta

SEQ ID NO: 2567 - DNA, 20 bp, Artificial sequence
  Synthetic oligonucleotide
gtccctcatcatctctacaa

SEQ ID NO: 2568 - DNA, 20 bp, Artificial sequence
  Synthetic oligonucleotide
tcccagtccctcatcatctc

SEQ ID NO: 2569 - DNA, 20 bp, Artificial sequence
  Synthetic oligonucleotide
caggctcccagtccctcatc

SEQ ID NO: 2570 - DNA, 20 bp, Artificial sequence
  Synthetic oligonucleotide
gtattcaggctcccagtccc

SEQ ID NO: 2571 - DNA, 20 bp, Artificial sequence
  Synthetic oligonucleotide
tgcttgaggtcagggtgtgg

SEQ ID NO: 2572 - DNA, 20 bp, Artificial sequence
  Synthetic oligonucleotide
tcacttgcttgaggtcaggg

SEQ ID NO: 2573 - DNA, 20 bp, Artificial sequence
  Synthetic oligonucleotide
caaaatcacttgcttgaggt

SEQ ID NO: 2574 - DNA, 20 bp, Artificial sequence
  Synthetic oligonucleotide
agaggcaaaatcacttgctt

SEQ ID NO: 2575 - DNA, 20 bp, Artificial sequence
  Synthetic oligonucleotide
ccacagcactctctgggaag

SEQ ID NO: 2576 - DNA, 20 bp, Artificial sequence
  Synthetic oligonucleotide
ccgtcccacagcactctctg

SEQ ID NO: 2577 - DNA, 20 bp, Artificial sequence
  Synthetic oligonucleotide
cttcaccgtcccacagcact

SEQ ID NO: 2578 - DNA, 20 bp, Artificial sequence
  Synthetic oligonucleotide
ggaaagcaatccccttctcc

SEQ ID NO: 2579 - DNA, 20 bp, Artificial sequence
  Synthetic oligonucleotide
cacccggaaagcaatcccct

SEQ ID NO: 2580 - DNA, 20 bp, Artificial sequence
  Synthetic oligonucleotide
tttaccacccggaaagcaat

SEQ ID NO: 2581 - DNA, 20 bp, Artificial sequence
  Synthetic oligonucleotide
gctcttttaccacccggaaa

SEQ ID NO: 2582 - DNA, 20 bp, Artificial sequence
  Synthetic oligonucleotide
gagcagctcttttaccaccc

SEQ ID NO: 2583 - DNA, 20 bp, Artificial sequence
  Synthetic oligonucleotide
gcagcacttgctttacacac

SEQ ID NO: 2584 - DNA, 20 bp, Artificial sequence
  Synthetic oligonucleotide
cccaggcagcacttgcttta

SEQ ID NO: 2585 - DNA, 20 bp, Artificial sequence
  Synthetic oligonucleotide
ctgctcccaggcagcacttg

SEQ ID NO: 2586 - DNA, 20 bp, Artificial sequence
  Synthetic oligonucleotide
acaaccctgctacctacaga

SEQ ID NO: 2587 - DNA, 20 bp, Artificial sequence
  Synthetic oligonucleotide
ggaacacaaccctgctacct

SEQ ID NO: 2588 - DNA, 20 bp, Artificial sequence
  Synthetic oligonucleotide
gtacaagtttctccacctat

SEQ ID NO: 2589 - DNA, 20 bp, Artificial sequence
  Synthetic oligonucleotide
cctaggtacaagtttctcca

SEQ ID NO: 2590 - DNA, 20 bp, Artificial sequence
  Synthetic oligonucleotide
ggactgaccccagagatggg

SEQ ID NO: 2591 - DNA, 20 bp, Artificial sequence
  Synthetic oligonucleotide
actgaggactgaccccagag

SEQ ID NO: 2592 - DNA, 20 bp, Artificial sequence
  Synthetic oligonucleotide
ccatcactgaggactgaccc

SEQ ID NO: 2593 - DNA, 20 bp, Artificial sequence
  Synthetic oligonucleotide
cagccccatcactgaggact

SEQ ID NO: 2594 - DNA, 20 bp, Artificial sequence
  Synthetic oligonucleotide
ggatgcccaagttagactgg

SEQ ID NO: 2595 - DNA, 20 bp, Artificial sequence
  Synthetic oligonucleotide
ccagagcagcctcagaggca

SEQ ID NO: 2596 - DNA, 20 bp, Artificial sequence
  Synthetic oligonucleotide
caaatccagagcagcctcag

SEQ ID NO: 2597 - DNA, 20 bp, Artificial sequence
  Synthetic oligonucleotide
ataagcaaatccagagcagc

SEQ ID NO: 2598 - DNA, 20 bp, Artificial sequence
  Synthetic oligonucleotide
aatccataagcaaatccaga

SEQ ID NO: 2599 - DNA, 20 bp, Artificial sequence
  Synthetic oligonucleotide
gagcaaatccataagcaaat

SEQ ID NO: 2600 - DNA, 20 bp, Artificial sequence
  Synthetic oligonucleotide
tagctgagcaaatccataag

SEQ ID NO: 2601 - DNA, 20 bp, Artificial sequence
  Synthetic oligonucleotide
ctgcatagctgagcaaatcc

SEQ ID NO: 2602 - DNA, 20 bp, Artificial sequence
  Synthetic oligonucleotide
gtttactgcatagctgagca

SEQ ID NO: 2603 - DNA, 20 bp, Artificial sequence
  Synthetic oligonucleotide
tagaggtttactgcatagct

SEQ ID NO: 2604 - DNA, 20 bp, Artificial sequence
  Synthetic oligonucleotide
gattcatctgtggtaagagg

SEQ ID NO: 2605 - DNA, 20 bp, Artificial sequence
  Synthetic oligonucleotide
tacctgattcatctgtggta

SEQ ID NO: 2606 - DNA, 20 bp, Artificial sequence
  Synthetic oligonucleotide
cttggtacctgattcatctg

SEQ ID NO: 2607 - DNA, 20 bp, Artificial sequence
  Synthetic oligonucleotide
ccaggacttggtacctgatt

SEQ ID NO: 2608 - DNA, 20 bp, Artificial sequence
  Synthetic oligonucleotide
gggtgccaggacttggtacc

SEQ ID NO: 2609 - DNA, 20 bp, Artificial sequence
  Synthetic oligonucleotide
gccatcccactgccagtgac

SEQ ID NO: 2610 - DNA, 20 bp, Artificial sequence
  Synthetic oligonucleotide
acagcaccaatgtcacttta

SEQ ID NO: 2611 - DNA, 20 bp, Artificial sequence
  Synthetic oligonucleotide
tctgcacactcccacagcac

SEQ ID NO: 2612 - DNA, 20 bp, Artificial sequence
  Synthetic oligonucleotide
ctctctctgcacactcccac

SEQ ID NO: 2613 - DNA, 20 bp, Artificial sequence
  Synthetic oligonucleotide
ctgcactctctctgcacact

SEQ ID NO: 2614 - DNA, 20 bp, Artificial sequence
  Synthetic oligonucleotide
gtcctggcctctaccctgaa

SEQ ID NO: 2615 - DNA, 20 bp, Artificial sequence
  Synthetic oligonucleotide
gaaggactgggatgctaggt

SEQ ID NO: 2616 - DNA, 20 bp, Artificial sequence
  Synthetic oligonucleotide
ggcatgaaggactgggatgc

SEQ ID NO: 2617 - DNA, 20 bp, Artificial sequence
  Synthetic oligonucleotide
agggaggcatgaaggactgg

SEQ ID NO: 2618 - DNA, 20 bp, Artificial sequence
  Synthetic oligonucleotide
gaaacagggaggcatgaagg

SEQ ID NO: 2619 - DNA, 20 bp, Artificial sequence
  Synthetic oligonucleotide
gtagagaaacagggaggcat

SEQ ID NO: 2620 - DNA, 20 bp, Artificial sequence
  Synthetic oligonucleotide
gaaaagtagagaaacaggga

SEQ ID NO: 2621 - DNA, 20 bp, Artificial sequence
  Synthetic oligonucleotide
agttggaaaagtagagaaac

SEQ ID NO: 2622 - DNA, 20 bp, Artificial sequence
  Synthetic oligonucleotide
gagtctagttggaaaagtag

SEQ ID NO: 2623 - DNA, 20 bp, Artificial sequence
  Synthetic oligonucleotide
actgtgagtctagttggaaa

SEQ ID NO: 2624 - DNA, 20 bp, Artificial sequence
  Synthetic oligonucleotide
cagagactgtgagtctagtt

SEQ ID NO: 2625 - DNA, 20 bp, Artificial sequence
  Synthetic oligonucleotide
cagcacagagactgtgagtc

SEQ ID NO: 2626 - DNA, 20 bp, Artificial sequence
  Synthetic oligonucleotide
gactgcagcacagagactgt

SEQ ID NO: 2627 - DNA, 20 bp, Artificial sequence
  Synthetic oligonucleotide
agtcagactgcagcacagag

SEQ ID NO: 2628 - DNA, 20 bp, Artificial sequence
  Synthetic oligonucleotide
agtttagtcagactgcagca

SEQ ID NO: 2629 - DNA, 20 bp, Artificial sequence
  Synthetic oligonucleotide
gatgccttccaggaggaagg

SEQ ID NO: 2630 - DNA, 20 bp, Artificial sequence
  Synthetic oligonucleotide
ttagggatgccttccaggag

SEQ ID NO: 2631 - DNA, 20 bp, Artificial sequence
  Synthetic oligonucleotide
tgttcttagggatgccttcc

SEQ ID NO: 2632 - DNA, 20 bp, Artificial sequence
  Synthetic oligonucleotide
aggctgagttctgctcctgg

SEQ ID NO: 2633 - DNA, 20 bp, Artificial sequence
  Synthetic oligonucleotide
gctagaggctgagttctgct

SEQ ID NO: 2634 - DNA, 20 bp, Artificial sequence
  Synthetic oligonucleotide
catctgctagaggctgagtt

SEQ ID NO: 2635 - DNA, 20 bp, Artificial sequence
  Synthetic oligonucleotide
ttgggcatctgctagaggct

SEQ ID NO: 2636 - DNA, 20 bp, Artificial sequence
  Synthetic oligonucleotide
gcttcttgggcatctgctag

SEQ ID NO: 2637 - DNA, 20 bp, Artificial sequence
  Synthetic oligonucleotide
cctctgcttcttgggcatct

SEQ ID NO: 2638 - DNA, 20 bp, Artificial sequence
  Synthetic oligonucleotide
tttctaagtaccctttacac

SEQ ID NO: 2639 - DNA, 20 bp, Artificial sequence
  Synthetic oligonucleotide
agtgctttctaagtaccctt

SEQ ID NO: 2640 - DNA, 20 bp, Artificial sequence
  Synthetic oligonucleotide
ggagagagaagggtggaacc

SEQ ID NO: 2641 - DNA, 20 bp, Artificial sequence
  Synthetic oligonucleotide
agaggaagggagagagaagg

SEQ ID NO: 2642 - DNA, 20 bp, Artificial sequence
  Synthetic oligonucleotide
gggaaaggtcttctccagct

SEQ ID NO: 2643 - DNA, 20 bp, Artificial sequence
  Synthetic oligonucleotide
caggagggaaaggtcttctc

SEQ ID NO: 2644 - DNA, 20 bp, Artificial sequence
  Synthetic oligonucleotide
ggaatcaggagggaaaggtc

SEQ ID NO: 2645 - DNA, 20 bp, Artificial sequence
  Synthetic oligonucleotide
gggtcaagcagagctttctg

SEQ ID NO: 2646 - DNA, 20 bp, Artificial sequence
  Synthetic oligonucleotide
atgaataaacagggcctaga

SEQ ID NO: 2647 - DNA, 20 bp, Artificial sequence
  Synthetic oligonucleotide
ctgtgatgaataaacagggc

SEQ ID NO: 2648 - DNA, 20 bp, Artificial sequence
  Synthetic oligonucleotide
tgaatgactgaatgcttgag

SEQ ID NO: 2649 - DNA, 20 bp, Artificial sequence
  Synthetic oligonucleotide
tttgctgaatgactgaatgc

SEQ ID NO: 2650 - DNA, 20 bp, Artificial sequence
  Synthetic oligonucleotide
tctcattcatctgggccctg

SEQ ID NO: 2651 - DNA, 20 bp, Artificial sequence
  Synthetic oligonucleotide
tgggaaaaggtatgtgtgtg

SEQ ID NO: 2652 - DNA, 20 bp, Artificial sequence
  Synthetic oligonucleotide
cattatgggaaaaggtatgt

SEQ ID NO: 2653 - DNA, 20 bp, Artificial sequence
  Synthetic oligonucleotide
tttctcattatgggaaaagg

SEQ ID NO: 2654 - DNA, 20 bp, Artificial sequence
  Synthetic oligonucleotide
agccctttctcattatggga

SEQ ID NO: 2655 - DNA, 20 bp, Artificial sequence
  Synthetic oligonucleotide
tactcagccctttctcatta

SEQ ID NO: 2656 - DNA, 20 bp, Artificial sequence
  Synthetic oligonucleotide
ccctgtactcagccctttct

SEQ ID NO: 2657 - DNA, 20 bp, Artificial sequence
  Synthetic oligonucleotide
ctcacccctgtactcagccc

SEQ ID NO: 2658 - DNA, 20 bp, Artificial sequence
  Synthetic oligonucleotide
cccatctcacccctgtactc

SEQ ID NO: 2659 - DNA, 20 bp, Artificial sequence
  Synthetic oligonucleotide
cctgtcccatctcacccctg

SEQ ID NO: 2660 - DNA, 20 bp, Artificial sequence
  Synthetic oligonucleotide
ccctgcctgtcccatctcac

SEQ ID NO: 2661 - DNA, 20 bp, Artificial sequence
  Synthetic oligonucleotide
agtcttccttctcctccacc

SEQ ID NO: 2662 - DNA, 20 bp, Artificial sequence
  Synthetic oligonucleotide
tggaaagtcttccttctcct

SEQ ID NO: 2663 - DNA, 20 bp, Artificial sequence
  Synthetic oligonucleotide
ttctctggaaagtcttcctt

SEQ ID NO: 2664 - DNA, 20 bp, Artificial sequence
  Synthetic oligonucleotide
ttggtcagtcttttagcaca

SEQ ID NO: 2665 - DNA, 20 bp, Artificial sequence
  Synthetic oligonucleotide
ctagtttggtcagtctttta

SEQ ID NO: 2666 - DNA, 20 bp, Artificial sequence
  Synthetic oligonucleotide
aggtagagttctattgcttc

SEQ ID NO: 2667 - DNA, 20 bp, Artificial sequence
  Synthetic oligonucleotide
gtctccacttggtgcctcac

SEQ ID NO: 2668 - DNA, 20 bp, Artificial sequence
  Synthetic oligonucleotide
aagctgtctccacttggtgc

SEQ ID NO: 2669 - DNA, 20 bp, Artificial sequence
  Synthetic oligonucleotide
acaggaagctgtctccactt

SEQ ID NO: 2670 - DNA, 20 bp, Artificial sequence
  Synthetic oligonucleotide
ctcacacaggaagctgtctc

SEQ ID NO: 2671 - DNA, 20 bp, Artificial sequence
  Synthetic oligonucleotide
agctgccatctctggagggt

SEQ ID NO: 2672 - DNA, 20 bp, Artificial sequence
  Synthetic oligonucleotide
ggcaaagctgccatctctgg

SEQ ID NO: 2673 - DNA, 20 bp, Artificial sequence
  Synthetic oligonucleotide
gtcatggcaaagctgccatc

SEQ ID NO: 2674 - DNA, 20 bp, Artificial sequence
  Synthetic oligonucleotide
cctttcagcgggagtccaca

SEQ ID NO: 2675 - DNA, 20 bp, Artificial sequence
  Synthetic oligonucleotide
ttccaggctcctccaggcag

SEQ ID NO: 2676 - DNA, 20 bp, Artificial sequence
  Synthetic oligonucleotide
ctctcttccaggctcctcca

SEQ ID NO: 2677 - DNA, 20 bp, Artificial sequence
  Synthetic oligonucleotide
atgccacttcatcaaggctg

SEQ ID NO: 2678 - DNA, 20 bp, Artificial sequence
  Synthetic oligonucleotide
aagagatgccacttcatcaa

SEQ ID NO: 2679 - DNA, 20 bp, Artificial sequence
  Synthetic oligonucleotide
tgccaaagagatgccacttc

SEQ ID NO: 2680 - DNA, 20 bp, Artificial sequence
  Synthetic oligonucleotide
ccaagtgccaaagagatgcc

SEQ ID NO: 2681 - DNA, 20 bp, Artificial sequence
  Synthetic oligonucleotide
tcaggccaagtgccaaagag

SEQ ID NO: 2682 - DNA, 20 bp, Artificial sequence
  Synthetic oligonucleotide
ggaagtcaggccaagtgcca

SEQ ID NO: 2683 - DNA, 20 bp, Artificial sequence
  Synthetic oligonucleotide
gtctaggaagtcaggccaag

SEQ ID NO: 2684 - DNA, 20 bp, Artificial sequence
  Synthetic oligonucleotide
gggaggtctaggaagtcagg

SEQ ID NO: 2685 - DNA, 20 bp, Artificial sequence
  Synthetic oligonucleotide
ccccagggaggtctaggaag

SEQ ID NO: 2686 - DNA, 20 bp, Artificial sequence
  Synthetic oligonucleotide
tccagccccagggaggtcta

SEQ ID NO: 2687 - DNA, 20 bp, Artificial sequence
  Synthetic oligonucleotide
gctcttccagccccagggag

SEQ ID NO: 2688 - DNA, 20 bp, Artificial sequence
  Synthetic oligonucleotide
agagtgagggtcagtacata

SEQ ID NO: 2689 - DNA, 20 bp, Artificial sequence
  Synthetic oligonucleotide
gtagcagagtgagggtcagt

SEQ ID NO: 2690 - DNA, 20 bp, Artificial sequence
  Synthetic oligonucleotide
taggtgagtgagaaagtcac

SEQ ID NO: 2691 - DNA, 20 bp, Artificial sequence
  Synthetic oligonucleotide
catctgcaccataatctgca

SEQ ID NO: 2692 - DNA, 20 bp, Artificial sequence
  Synthetic oligonucleotide
tttacccaaaaggttcacag

SEQ ID NO: 2693 - DNA, 20 bp, Artificial sequence
  Synthetic oligonucleotide
attgatttacccaaaaggtt

SEQ ID NO: 2694 - DNA, 20 bp, Artificial sequence
  Synthetic oligonucleotide
gagtttgtgtttcccatttc

SEQ ID NO: 2695 - DNA, 20 bp, Artificial sequence
  Synthetic oligonucleotide
aaaaggagtttgtgtttccc

SEQ ID NO: 2696 - DNA, 20 bp, Artificial sequence
  Synthetic oligonucleotide
ataagaaaaggagtttgtgt

SEQ ID NO: 2697 - DNA, 20 bp, Artificial sequence
  Synthetic oligonucleotide
ctctaataagaaaaggagtt

SEQ ID NO: 2698 - DNA, 20 bp, Artificial sequence
  Synthetic oligonucleotide
ttctgctctaataagaaaag

SEQ ID NO: 2699 - DNA, 20 bp, Artificial sequence
  Synthetic oligonucleotide
gctaattctgctctaataag

SEQ ID NO: 2700 - DNA, 20 bp, Artificial sequence
  Synthetic oligonucleotide
gaatggctaattctgctcta

SEQ ID NO: 2701 - DNA, 20 bp, Artificial sequence
  Synthetic oligonucleotide
gcttagaatggctaattctg

SEQ ID NO: 2702 - DNA, 20 bp, Artificial sequence
  Synthetic oligonucleotide
gcagggcttagaatggctaa

SEQ ID NO: 2703 - DNA, 20 bp, Artificial sequence
  Synthetic oligonucleotide
cagaggcagggcttagaatg

SEQ ID NO: 2704 - DNA, 20 bp, Artificial sequence
  Synthetic oligonucleotide
ggaagcagaggcagggctta

SEQ ID NO: 2705 - DNA, 20 bp, Artificial sequence
  Synthetic oligonucleotide
acatgggaagcagaggcagg

SEQ ID NO: 2706 - DNA, 20 bp, Artificial sequence
  Synthetic oligonucleotide
aggtcacatgggaagcagag

SEQ ID NO: 2707 - DNA, 20 bp, Artificial sequence
  Synthetic oligonucleotide
tcctcactgtgcagatgaga

SEQ ID NO: 2708 - DNA, 20 bp, Artificial sequence
  Synthetic oligonucleotide
agtcctcctcactgtgcaga

SEQ ID NO: 2709 - DNA, 20 bp, Artificial sequence
  Synthetic oligonucleotide
caaccagtcctcctcactgt

SEQ ID NO: 2710 - DNA, 20 bp, Artificial sequence
  Synthetic oligonucleotide
catctcaaccagtcctcctc

SEQ ID NO: 2711 - DNA, 20 bp, Artificial sequence
  Synthetic oligonucleotide
ttagggacaagaatggaatc

SEQ ID NO: 2712 - DNA, 20 bp, Artificial sequence
  Synthetic oligonucleotide
agcagttagggacaagaatg

SEQ ID NO: 2713 - DNA, 20 bp, Artificial sequence
  Synthetic oligonucleotide
cccacagcagttagggacaa

SEQ ID NO: 2714 - DNA, 20 bp, Artificial sequence
  Synthetic oligonucleotide
ttttcacaaggagaagctga

SEQ ID NO: 2715 - DNA, 20 bp, Artificial sequence
  Synthetic oligonucleotide
caccattttcacaaggagaa

SEQ ID NO: 2716 - DNA, 20 bp, Artificial sequence
  Synthetic oligonucleotide
gagtgcaccattttcacaag

SEQ ID NO: 2717 - DNA, 20 bp, Artificial sequence
  Synthetic oligonucleotide
atcacaatatatgggcaagc

SEQ ID NO: 2718 - DNA, 20 bp, Artificial sequence
  Synthetic oligonucleotide
tccccatcacaatatatggg

SEQ ID NO: 2719 - DNA, 20 bp, Artificial sequence
  Synthetic oligonucleotide
caaggaatctccaaaatacg

SEQ ID NO: 2720 - DNA, 20 bp, Artificial sequence
  Synthetic oligonucleotide
atggcaacactactagcttg

SEQ ID NO: 2721 - DNA, 20 bp, Artificial sequence
  Synthetic oligonucleotide
ctgccatggcaacactacta

SEQ ID NO: 2722 - DNA, 20 bp, Artificial sequence
  Synthetic oligonucleotide
tagctactgcagtggaaggg

SEQ ID NO: 2723 - DNA, 20 bp, Artificial sequence
  Synthetic oligonucleotide
aaaagtagctactgcagtgg

SEQ ID NO: 2724 - DNA, 20 bp, Artificial sequence
  Synthetic oligonucleotide
attcaaaaagtagctactgc

SEQ ID NO: 2725 - DNA, 20 bp, Artificial sequence
  Synthetic oligonucleotide
agcacattcaaaaagtagct

SEQ ID NO: 2726 - DNA, 20 bp, Artificial sequence
  Synthetic oligonucleotide
ctggacatgattgctgagga

SEQ ID NO: 2727 - DNA, 20 bp, Artificial sequence
  Synthetic oligonucleotide
ggaccctggacatgattgct

SEQ ID NO: 2728 - DNA, 20 bp, Artificial sequence
  Synthetic oligonucleotide
atccaggaccctggacatga

SEQ ID NO: 2729 - DNA, 20 bp, Artificial sequence
  Synthetic oligonucleotide
ttcctgataccgaacatgga

SEQ ID NO: 2730 - DNA, 20 bp, Artificial sequence
  Synthetic oligonucleotide
ggtaaggccaaggaagtgag

SEQ ID NO: 2731 - DNA, 20 bp, Artificial sequence
  Synthetic oligonucleotide
caagaggtaaggccaaggaa

SEQ ID NO: 2732 - DNA, 20 bp, Artificial sequence
  Synthetic oligonucleotide
acctgggtttttgtgtattc

SEQ ID NO: 2733 - DNA, 20 bp, Artificial sequence
  Synthetic oligonucleotide
catacacctgggtttttgtg

SEQ ID NO: 2734 - DNA, 20 bp, Artificial sequence
  Synthetic oligonucleotide
tactccatacacctgggttt

SEQ ID NO: 2735 - DNA, 20 bp, Artificial sequence
  Synthetic oligonucleotide
ttatccacagaagatctccc

SEQ ID NO: 2736 - DNA, 20 bp, Artificial sequence
  Synthetic oligonucleotide
ctgagtgctgctaacttggg

SEQ ID NO: 2737 - DNA, 20 bp, Artificial sequence
  Synthetic oligonucleotide
gaaatctgagtgctgctaac

SEQ ID NO: 2738 - DNA, 20 bp, Artificial sequence
  Synthetic oligonucleotide
cactaaattaggaagctggg

SEQ ID NO: 2739 - DNA, 20 bp, Artificial sequence
  Synthetic oligonucleotide
ccctctctaggtttccccat

SEQ ID NO: 2740 - DNA, 20 bp, Artificial sequence
  Synthetic oligonucleotide
tcctcccctctctaggtttc

SEQ ID NO: 2741 - DNA, 20 bp, Artificial sequence
  Synthetic oligonucleotide
cctcttcctcccctctctag

SEQ ID NO: 2742 - DNA, 20 bp, Artificial sequence
  Synthetic oligonucleotide
ctaagcctcttcctcccctc

SEQ ID NO: 2743 - DNA, 20 bp, Artificial sequence
  Synthetic oligonucleotide
gcctgctgcagggagccagg

SEQ ID NO: 2744 - DNA, 20 bp, Artificial sequence
  Synthetic oligonucleotide
ggccatcaggaccctgcagg

SEQ ID NO: 2745 - DNA, 20 bp, Artificial sequence
  Synthetic oligonucleotide
aagtgggccatcaggaccct

SEQ ID NO: 2746 - DNA, 20 bp, Artificial sequence
  Synthetic oligonucleotide
gtgtgccaggtgggaagtgg

SEQ ID NO: 2747 - DNA, 20 bp, Artificial sequence
  Synthetic oligonucleotide
gctaggtgtgccaggtggga

SEQ ID NO: 2748 - DNA, 20 bp, Artificial sequence
  Synthetic oligonucleotide
gctatgctaggtgtgccagg

SEQ ID NO: 2749 - DNA, 20 bp, Artificial sequence
  Synthetic oligonucleotide
acacagctatgctaggtgtg

SEQ ID NO: 2750 - DNA, 20 bp, Artificial sequence
  Synthetic oligonucleotide
ccagcacacagctatgctag

SEQ ID NO: 2751 - DNA, 20 bp, Artificial sequence
  Synthetic oligonucleotide
gagagccagcacacagctat

SEQ ID NO: 2752 - DNA, 20 bp, Artificial sequence
  Synthetic oligonucleotide
tactggagagccagcacaca

SEQ ID NO: 2753 - DNA, 20 bp, Artificial sequence
  Synthetic oligonucleotide
caaactactggagagccagc

SEQ ID NO: 2754 - DNA, 20 bp, Artificial sequence
  Synthetic oligonucleotide
tgggacatctggcccaaagg

SEQ ID NO: 2755 - DNA, 20 bp, Artificial sequence
  Synthetic oligonucleotide
cccactgggacatctggccc

SEQ ID NO: 2756 - DNA, 20 bp, Artificial sequence
  Synthetic oligonucleotide
cttaaagcagggcccactgg

SEQ ID NO: 2757 - DNA, 20 bp, Artificial sequence
  Synthetic oligonucleotide
gtatccttaaagcagggccc

SEQ ID NO: 2758 - DNA, 20 bp, Artificial sequence
  Synthetic oligonucleotide
ttcttttctgaaaagattaa

SEQ ID NO: 2759 - DNA, 20 bp, Artificial sequence
  Synthetic oligonucleotide
gtgagttcttttctgaaaag

SEQ ID NO: 2760 - DNA, 20 bp, Artificial sequence
  Synthetic oligonucleotide
actggtgcctaagagcccta

SEQ ID NO: 2761 - DNA, 20 bp, Artificial sequence
  Synthetic oligonucleotide
cctccactggtgcctaagag

SEQ ID NO: 2762 - DNA, 20 bp, Artificial sequence
  Synthetic oligonucleotide
cactccctccactggtgcct

SEQ ID NO: 2763 - DNA, 20 bp, Artificial sequence
  Synthetic oligonucleotide
agaagacagccagtcagagc

SEQ ID NO: 2764 - DNA, 20 bp, Artificial sequence
  Synthetic oligonucleotide
ggcagagaagacagccagtc

SEQ ID NO: 2765 - DNA, 20 bp, Artificial sequence
  Synthetic oligonucleotide
ctgaaggcagagaagacagc

SEQ ID NO: 2766 - DNA, 20 bp, Artificial sequence
  Synthetic oligonucleotide
ctaccctgaaggcagagaag

SEQ ID NO: 2767 - DNA, 20 bp, Artificial sequence
  Synthetic oligonucleotide
ggcctctaccctgaaggcag

SEQ ID NO: 2768 - DNA, 20 bp, Artificial sequence
  Synthetic oligonucleotide
tgtcagaaaggactcctctg

SEQ ID NO: 2769 - DNA, 20 bp, Artificial sequence
  Synthetic oligonucleotide
acagctgtcagaaaggactc

SEQ ID NO: 2770 - DNA, 20 bp, Artificial sequence
  Synthetic oligonucleotide
cctcaacagctgtcagaaag

SEQ ID NO: 2771 - DNA, 20 bp, Artificial sequence
  Synthetic oligonucleotide
acccaccccagcctgttgca

SEQ ID NO: 2772 - DNA, 20 bp, Artificial sequence
  Synthetic oligonucleotide
caagcagatccacagtgatg

SEQ ID NO: 2773 - DNA, 20 bp, Artificial sequence
  Synthetic oligonucleotide
agtttcaagcagatccacag

SEQ ID NO: 2774 - DNA, 20 bp, Artificial sequence
  Synthetic oligonucleotide
cccccaacaatctagccact

SEQ ID NO: 2775 - DNA, 20 bp, Artificial sequence
  Synthetic oligonucleotide
agttacccccaacaatctag

SEQ ID NO: 2776 - DNA, 20 bp, Artificial sequence
  Synthetic oligonucleotide
ttcccagttacccccaacaa

SEQ ID NO: 2777 - DNA, 20 bp, Artificial sequence
  Synthetic oligonucleotide
ctcagttcccagttaccccc

SEQ ID NO: 2778 - DNA, 20 bp, Artificial sequence
  Synthetic oligonucleotide
caaccctcagttcccagtta

SEQ ID NO: 2779 - DNA, 20 bp, Artificial sequence
  Synthetic oligonucleotide
tctgacttaggactaggtta

SEQ ID NO: 2780 - DNA, 20 bp, Artificial sequence
  Synthetic oligonucleotide
ctcattctgacttaggacta

SEQ ID NO: 2781 - DNA, 20 bp, Artificial sequence
  Synthetic oligonucleotide
atgttctcattctgacttag

SEQ ID NO: 2782 - DNA, 20 bp, Artificial sequence
  Synthetic oligonucleotide
gagtaatgttctcattctga

SEQ ID NO: 2783 - DNA, 20 bp, Artificial sequence
  Synthetic oligonucleotide
catgagagtaatgttctcat

SEQ ID NO: 2784 - DNA, 20 bp, Artificial sequence
  Synthetic oligonucleotide
ggaagtgatgtaggtgaggg

SEQ ID NO: 2785 - DNA, 20 bp, Artificial sequence
  Synthetic oligonucleotide
agcctagatgagcccttggt

SEQ ID NO: 2786 - DNA, 20 bp, Artificial sequence
  Synthetic oligonucleotide
ttctcagcctagatgagccc

SEQ ID NO: 2787 - DNA, 20 bp, Artificial sequence
  Synthetic oligonucleotide
ctcctttctcagcctagatg

SEQ ID NO: 2788 - DNA, 20 bp, Artificial sequence
  Synthetic oligonucleotide
tggccctcctttctcagcct

SEQ ID NO: 2789 - DNA, 20 bp, Artificial sequence
  Synthetic oligonucleotide
actcttggccctcctttctc

SEQ ID NO: 2790 - DNA, 20 bp, Artificial sequence
  Synthetic oligonucleotide
acattactcttggccctcct

SEQ ID NO: 2791 - DNA, 20 bp, Artificial sequence
  Synthetic oligonucleotide
ttgctgttgaatttgagggc

SEQ ID NO: 2792 - DNA, 20 bp, Artificial sequence
  Synthetic oligonucleotide
agtacttgctgttgaatttg

SEQ ID NO: 2793 - DNA, 20 bp, Artificial sequence
  Synthetic oligonucleotide
cagcactaatttttacaact

SEQ ID NO: 2794 - DNA, 20 bp, Artificial sequence
  Synthetic oligonucleotide
atctgtaacatgagggttgg

SEQ ID NO: 2795 - DNA, 20 bp, Artificial sequence
  Synthetic oligonucleotide
atcccatctgtaacatgagg

SEQ ID NO: 2796 - DNA, 20 bp, Artificial sequence
  Synthetic oligonucleotide
cagtgatcccatctgtaaca

SEQ ID NO: 2797 - DNA, 20 bp, Artificial sequence
  Synthetic oligonucleotide
gcctggctttgataaccctg

SEQ ID NO: 2798 - DNA, 20 bp, Artificial sequence
  Synthetic oligonucleotide
ttctagcctggctttgataa

SEQ ID NO: 2799 - DNA, 20 bp, Artificial sequence
  Synthetic oligonucleotide
cagactgggagatggatctg

SEQ ID NO: 2800 - DNA, 20 bp, Artificial sequence
  Synthetic oligonucleotide
ggccacagactgggagatgg

SEQ ID NO: 2801 - DNA, 20 bp, Artificial sequence
  Synthetic oligonucleotide
agtcaggccacagactggga

SEQ ID NO: 2802 - DNA, 20 bp, Artificial sequence
  Synthetic oligonucleotide
taaggagtcaggccacagac

SEQ ID NO: 2803 - DNA, 20 bp, Artificial sequence
  Synthetic oligonucleotide
tggcttaaggagtcaggcca

SEQ ID NO: 2804 - DNA, 20 bp, Artificial sequence
  Synthetic oligonucleotide
tctcttggcttaaggagtca

SEQ ID NO: 2805 - DNA, 20 bp, Artificial sequence
  Synthetic oligonucleotide
gccctgcactcagcccttca

SEQ ID NO: 2806 - DNA, 20 bp, Artificial sequence
  Synthetic oligonucleotide
acagagccctgcactcagcc

SEQ ID NO: 2807 - DNA, 20 bp, Artificial sequence
  Synthetic oligonucleotide
gacaaccttcactcattcag

SEQ ID NO: 2808 - DNA, 20 bp, Artificial sequence
  Synthetic oligonucleotide
atccactagggcaggcttgg

SEQ ID NO: 2809 - DNA, 20 bp, Artificial sequence
  Synthetic oligonucleotide
ggccaggaggaagagtttgg

SEQ ID NO: 2810 - DNA, 20 bp, Artificial sequence
  Synthetic oligonucleotide
tcataggccaggaggaagag

SEQ ID NO: 2811 - DNA, 20 bp, Artificial sequence
  Synthetic oligonucleotide
ttacttcataggccaggagg

SEQ ID NO: 2812 - DNA, 20 bp, Artificial sequence
  Synthetic oligonucleotide
tggcagtggaggctgttcac

SEQ ID NO: 2813 - DNA, 20 bp, Artificial sequence
  Synthetic oligonucleotide
gcaggaacaggaagaccacc

SEQ ID NO: 2814 - DNA, 20 bp, Artificial sequence
  Synthetic oligonucleotide
atgctgcaggaacaggaaga

SEQ ID NO: 2815 - DNA, 20 bp, Artificial sequence
  Synthetic oligonucleotide
gagtaatgctgcaggaacag

SEQ ID NO: 2816 - DNA, 20 bp, Artificial sequence
  Synthetic oligonucleotide
attgggagtaatgctgcagg

SEQ ID NO: 2817 - DNA, 20 bp, Artificial sequence
  Synthetic oligonucleotide
tggctctctagatagggtgg

SEQ ID NO: 2818 - DNA, 20 bp, Artificial sequence
  Synthetic oligonucleotide
taaaagaagatgtggtgatt

SEQ ID NO: 2819 - DNA, 20 bp, Artificial sequence
  Synthetic oligonucleotide
aaaaataaaagaagatgtgg

SEQ ID NO: 2820 - DNA, 20 bp, Artificial sequence
  Synthetic oligonucleotide
gctataaaaataaaagaaga

SEQ ID NO: 2821 - DNA, 20 bp, Artificial sequence
  Synthetic oligonucleotide
taaaggctataaaaataaaa

SEQ ID NO: 2822 - DNA, 20 bp, Artificial sequence
  Synthetic oligonucleotide
attgcttaaacagataagca

SEQ ID NO: 2823 - DNA, 20 bp, Artificial sequence
  Synthetic oligonucleotide
agacaattgcttaaacagat

SEQ ID NO: 2824 - DNA, 20 bp, Artificial sequence
  Synthetic oligonucleotide
gttcctgtttccaagggact

SEQ ID NO: 2825 - DNA, 20 bp, Artificial sequence
  Synthetic oligonucleotide
acaaggttcctgtttccaag

SEQ ID NO: 2826 - DNA, 20 bp, Artificial sequence
  Synthetic oligonucleotide
gacagacaaggttcctgttt

SEQ ID NO: 2827 - DNA, 20 bp, Artificial sequence
  Synthetic oligonucleotide
agaaagacagacaaggttcc

SEQ ID NO: 2828 - DNA, 20 bp, Artificial sequence
  Synthetic oligonucleotide
cactgagaaagacagacaag

SEQ ID NO: 2829 - DNA, 20 bp, Artificial sequence
  Synthetic oligonucleotide
cacagcactgagaaagacag

SEQ ID NO: 2830 - DNA, 20 bp, Artificial sequence
  Synthetic oligonucleotide
gccaggcactgtgctagatg

SEQ ID NO: 2831 - DNA, 20 bp, Artificial sequence
  Synthetic oligonucleotide
ccagtgccaggcactgtgct

SEQ ID NO: 2832 - DNA, 20 bp, Artificial sequence
  Synthetic oligonucleotide
tattaccagtgccaggcact

SEQ ID NO: 2833 - DNA, 20 bp, Artificial sequence
  Synthetic oligonucleotide
gtacctattaccagtgccag

SEQ ID NO: 2834 - DNA, 20 bp, Artificial sequence
  Synthetic oligonucleotide
actaagtacctattaccagt

SEQ ID NO: 2835 - DNA, 20 bp, Artificial sequence
  Synthetic oligonucleotide
agctaaaagcagggcttcct

SEQ ID NO: 2836 - DNA, 20 bp, Artificial sequence
  Synthetic oligonucleotide
gctccttgccagactgtggg

SEQ ID NO: 2837 - DNA, 20 bp, Artificial sequence
  Synthetic oligonucleotide
agccagctccttgccagact

SEQ ID NO: 2838 - DNA, 20 bp, Artificial sequence
  Synthetic oligonucleotide
cttggagccagctccttgcc

SEQ ID NO: 2839 - DNA, 20 bp, Artificial sequence
  Synthetic oligonucleotide
tcagccttggagccagctcc

SEQ ID NO: 2840 - DNA, 20 bp, Artificial sequence
  Synthetic oligonucleotide
gccactcagccttggagcca

SEQ ID NO: 2841 - DNA, 20 bp, Artificial sequence
  Synthetic oligonucleotide
ggaagcagtaagggtgacca

SEQ ID NO: 2842 - DNA, 20 bp, Artificial sequence
  Synthetic oligonucleotide
agccctgggaagcagtaagg

SEQ ID NO: 2843 - DNA, 20 bp, Artificial sequence
  Synthetic oligonucleotide
taataagccctgggaagcag

SEQ ID NO: 2844 - DNA, 20 bp, Artificial sequence
  Synthetic oligonucleotide
atccccagagaggaagtgaa

SEQ ID NO: 2845 - DNA, 20 bp, Artificial sequence
  Synthetic oligonucleotide
ataaccacagcgataatcac

SEQ ID NO: 2846 - DNA, 20 bp, Artificial sequence
  Synthetic oligonucleotide
ggcagataaccacagcgata

SEQ ID NO: 2847 - DNA, 20 bp, Artificial sequence
  Synthetic oligonucleotide
cagcacccacaccaagaggg

SEQ ID NO: 2848 - DNA, 20 bp, Artificial sequence
  Synthetic oligonucleotide
tcagaggctactggctggat

SEQ ID NO: 2849 - DNA, 20 bp, Artificial sequence
  Synthetic oligonucleotide
ggctgtcagaggctactggc

SEQ ID NO: 2850 - DNA, 20 bp, Artificial sequence
  Synthetic oligonucleotide
aaaaggactcaagtgagaga

SEQ ID NO: 2851 - DNA, 20 bp, Artificial sequence
  Synthetic oligonucleotide
aacagaaaaggactcaagtg

SEQ ID NO: 2852 - DNA, 20 bp, Artificial sequence
  Synthetic oligonucleotide
cagggaacagaaaaggactc

SEQ ID NO: 2853 - DNA, 20 bp, Artificial sequence
  Synthetic oligonucleotide
ggacacagggaacagaaaag

SEQ ID NO: 2854 - DNA, 20 bp, Artificial sequence
  Synthetic oligonucleotide
tcaaaggacacagggaacag

SEQ ID NO: 2855 - DNA, 20 bp, Artificial sequence
  Synthetic oligonucleotide
ggacatcaaaggacacaggg

SEQ ID NO: 2856 - DNA, 20 bp, Artificial sequence
  Synthetic oligonucleotide
cctaaggacatcaaaggaca

SEQ ID NO: 2857 - DNA, 20 bp, Artificial sequence
  Synthetic oligonucleotide
gcatgaacaagggcaagtcc

SEQ ID NO: 2858 - DNA, 20 bp, Artificial sequence
  Synthetic oligonucleotide
agaacatccctatcccactg

SEQ ID NO: 2859 - DNA, 20 bp, Artificial sequence
  Synthetic oligonucleotide
cacagagaacatccctatcc

SEQ ID NO: 2860 - DNA, 20 bp, Artificial sequence
  Synthetic oligonucleotide
cctgtggatggcagagccga

SEQ ID NO: 2861 - DNA, 20 bp, Artificial sequence
  Synthetic oligonucleotide
cccagcctgtggatggcaga

SEQ ID NO: 2862 - DNA, 20 bp, Artificial sequence
  Synthetic oligonucleotide
cagctcccagcctgtggatg

SEQ ID NO: 2863 - DNA, 20 bp, Artificial sequence
  Synthetic oligonucleotide
catgacagccagggtcactg

SEQ ID NO: 2864 - DNA, 20 bp, Artificial sequence
  Synthetic oligonucleotide
caaaaacatgacagccaggg

SEQ ID NO: 2865 - DNA, 20 bp, Artificial sequence
  Synthetic oligonucleotide
taagtcaaaaacatgacagc

SEQ ID NO: 2866 - DNA, 20 bp, Artificial sequence
  Synthetic oligonucleotide
aactctaagtcaaaaacatg

SEQ ID NO: 2867 - DNA, 20 bp, Artificial sequence
  Synthetic oligonucleotide
gaacaaactctaagtcaaaa

SEQ ID NO: 2868 - DNA, 20 bp, Artificial sequence
  Synthetic oligonucleotide
ctaaggaacaaactctaagt

SEQ ID NO: 2869 - DNA, 20 bp, Artificial sequence
  Synthetic oligonucleotide
ttctcctaaggaacaaactc

SEQ ID NO: 2870 - DNA, 20 bp, Artificial sequence
  Synthetic oligonucleotide
acaagttctcctaaggaaca

SEQ ID NO: 2871 - DNA, 20 bp, Artificial sequence
  Synthetic oligonucleotide
agagtacaagttctcctaag

SEQ ID NO: 2872 - DNA, 20 bp, Artificial sequence
  Synthetic oligonucleotide
tcgctagagtacaagttctc

SEQ ID NO: 2873 - DNA, 20 bp, Artificial sequence
  Synthetic oligonucleotide
tcctgacatgatattaagtg

SEQ ID NO: 2874 - DNA, 20 bp, Artificial sequence
  Synthetic oligonucleotide
aatgttcctgacatgatatt

SEQ ID NO: 2875 - DNA, 20 bp, Artificial sequence
  Synthetic oligonucleotide
atgatgtaaatccttgcacc

SEQ ID NO: 2876 - DNA, 20 bp, Artificial sequence
  Synthetic oligonucleotide
attccatgatgtaaatcctt

SEQ ID NO: 2877 - DNA, 20 bp, Artificial sequence
  Synthetic oligonucleotide
cctacattccatgatgtaaa

SEQ ID NO: 2878 - DNA, 20 bp, Artificial sequence
  Synthetic oligonucleotide
cccttcctacattccatgat

SEQ ID NO: 2879 - DNA, 20 bp, Artificial sequence
  Synthetic oligonucleotide
accagcccttcctacattcc

SEQ ID NO: 2880 - DNA, 20 bp, Artificial sequence
  Synthetic oligonucleotide
ttcataccagcccttcctac

SEQ ID NO: 2881 - DNA, 20 bp, Artificial sequence
  Synthetic oligonucleotide
aagctgaactgactggtttg

SEQ ID NO: 2882 - DNA, 20 bp, Artificial sequence
  Synthetic oligonucleotide
ccagaaagctgaactgactg

SEQ ID NO: 2883 - DNA, 20 bp, Artificial sequence
  Synthetic oligonucleotide
agatcccagaaagctgaact

SEQ ID NO: 2884 - DNA, 20 bp, Artificial sequence
  Synthetic oligonucleotide
aaagtagatcccagaaagct

SEQ ID NO: 2885 - DNA, 20 bp, Artificial sequence
  Synthetic oligonucleotide
tcaccaaagtagatcccaga

SEQ ID NO: 2886 - DNA, 20 bp, Artificial sequence
  Synthetic oligonucleotide
atctttcaccaaagtagatc

SEQ ID NO: 2887 - DNA, 20 bp, Artificial sequence
  Synthetic oligonucleotide
acccaatctttcaccaaagt

SEQ ID NO: 2888 - DNA, 20 bp, Artificial sequence
  Synthetic oligonucleotide
actccacccaatctttcacc

SEQ ID NO: 2889 - DNA, 20 bp, Artificial sequence
  Synthetic oligonucleotide
cccctactccacccaatctt

SEQ ID NO: 2890 - DNA, 20 bp, Artificial sequence
  Synthetic oligonucleotide
gccctcccctactccaccca

SEQ ID NO: 2891 - DNA, 20 bp, Artificial sequence
  Synthetic oligonucleotide
tcagtgccctcccctactcc

SEQ ID NO: 2892 - DNA, 20 bp, Artificial sequence
  Synthetic oligonucleotide
tgcccagataacaaaatgtg

SEQ ID NO: 2893 - DNA, 20 bp, Artificial sequence
  Synthetic oligonucleotide
ggagatgcccagataacaaa

SEQ ID NO: 2894 - DNA, 20 bp, Artificial sequence
  Synthetic oligonucleotide
caaggatctagaaggcaggt

SEQ ID NO: 2895 - DNA, 20 bp, Artificial sequence
  Synthetic oligonucleotide
aggaccaaggatctagaagg

SEQ ID NO: 2896 - DNA, 20 bp, Artificial sequence
  Synthetic oligonucleotide
cttcaaggaccaaggatcta

SEQ ID NO: 2897 - DNA, 20 bp, Artificial sequence
  Synthetic oligonucleotide
agtatcttcaaggaccaagg

SEQ ID NO: 2898 - DNA, 20 bp, Artificial sequence
  Synthetic oligonucleotide
aggcaaactaggccactggg

SEQ ID NO: 2899 - DNA, 20 bp, Artificial sequence
  Synthetic oligonucleotide
cacagaggcaaactaggcca

SEQ ID NO: 2900 - DNA, 20 bp, Artificial sequence
  Synthetic oligonucleotide
ctcacaacagtgggacctta

SEQ ID NO: 2901 - DNA, 20 bp, Artificial sequence
  Synthetic oligonucleotide
accagctcacaacagtggga

SEQ ID NO: 2902 - DNA, 20 bp, Artificial sequence
  Synthetic oligonucleotide
tgttcaccagctcacaacag

SEQ ID NO: 2903 - DNA, 20 bp, Artificial sequence
  Synthetic oligonucleotide
catggtctctacttgaatac

SEQ ID NO: 2904 - DNA, 20 bp, Artificial sequence
  Synthetic oligonucleotide
gaatccatggtctctacttg

SEQ ID NO: 2905 - DNA, 20 bp, Artificial sequence
  Synthetic oligonucleotide
tcacagaatccatggtctct

SEQ ID NO: 2906 - DNA, 20 bp, Artificial sequence
  Synthetic oligonucleotide
tcccttcacagaatccatgg

SEQ ID NO: 2907 - DNA, 20 bp, Artificial sequence
  Synthetic oligonucleotide
ggacttcccttcacagaatc

SEQ ID NO: 2908 - DNA, 20 bp, Artificial sequence
  Synthetic oligonucleotide
tcacaggacttcccttcaca

SEQ ID NO: 2909 - DNA, 20 bp, Artificial sequence
  Synthetic oligonucleotide
acctacccatactcccacag

SEQ ID NO: 2910 - DNA, 20 bp, Artificial sequence
  Synthetic oligonucleotide
cacccacctacccatactcc

SEQ ID NO: 2911 - DNA, 20 bp, Artificial sequence
  Synthetic oligonucleotide
gcatgcacccacctacccat

SEQ ID NO: 2912 - DNA, 20 bp, Artificial sequence
  Synthetic oligonucleotide
ccccagcatgcacccaccta

SEQ ID NO: 2913 - DNA, 20 bp, Artificial sequence
  Synthetic oligonucleotide
gcttcccccagcatgcaccc

SEQ ID NO: 2914 - DNA, 20 bp, Artificial sequence
  Synthetic oligonucleotide
ggcacaggacagccctccaa

SEQ ID NO: 2915 - DNA, 20 bp, Artificial sequence
  Synthetic oligonucleotide
tgtcctgatgaactctgcaa

SEQ ID NO: 2916 - DNA, 20 bp, Artificial sequence
  Synthetic oligonucleotide
tgtcagagggctcttctgaa

SEQ ID NO: 2917 - DNA, 20 bp, Artificial sequence
  Synthetic oligonucleotide
gcaggtgtcagagggctctt

SEQ ID NO: 2918 - DNA, 20 bp, Artificial sequence
  Synthetic oligonucleotide
tctcatgctaggtcctgtgc

SEQ ID NO: 2919 - DNA, 20 bp, Artificial sequence
  Synthetic oligonucleotide
ctctgctacatcaaaacttg

SEQ ID NO: 2920 - DNA, 20 bp, Artificial sequence
  Synthetic oligonucleotide
gactcctctgctacatcaaa

SEQ ID NO: 2921 - DNA, 20 bp, Artificial sequence
  Synthetic oligonucleotide
gaaaggactcctctgctaca

SEQ ID NO: 2922 - DNA, 20 bp, Artificial sequence
  Synthetic oligonucleotide
ttgggtctgatcaattatta

SEQ ID NO: 2923 - DNA, 20 bp, Artificial sequence
  Synthetic oligonucleotide
tgtggttgggtctgatcaat

SEQ ID NO: 2924 - DNA, 20 bp, Artificial sequence
  Synthetic oligonucleotide
ggtttctgggctgtggttgg

SEQ ID NO: 2925 - DNA, 20 bp, Artificial sequence
  Synthetic oligonucleotide
gatgctgggccggtttctgg

SEQ ID NO: 2926 - DNA, 20 bp, Artificial sequence
  Synthetic oligonucleotide
caggagatctgcctgtccaa

SEQ ID NO: 2927 - DNA, 20 bp, Artificial sequence
  Synthetic oligonucleotide
tagctcaggagatctgcctg

SEQ ID NO: 2928 - DNA, 20 bp, Artificial sequence
  Synthetic oligonucleotide
agcagtagctcaggagatct

SEQ ID NO: 2929 - DNA, 20 bp, Artificial sequence
  Synthetic oligonucleotide
taattagcagtagctcagga

SEQ ID NO: 2930 - DNA, 20 bp, Artificial sequence
  Synthetic oligonucleotide
aggtttgagaggcagaggga

SEQ ID NO: 2931 - DNA, 20 bp, Artificial sequence
  Synthetic oligonucleotide
ccagcaggtttgagaggcag

SEQ ID NO: 2932 - DNA, 20 bp, Artificial sequence
  Synthetic oligonucleotide
ttctgccagcaggtttgaga

SEQ ID NO: 2933 - DNA, 20 bp, Artificial sequence
  Synthetic oligonucleotide
tgagcttctgccagcaggtt

SEQ ID NO: 2934 - DNA, 20 bp, Artificial sequence
  Synthetic oligonucleotide
ccaggtgagcttctgccagc

SEQ ID NO: 2935 - DNA, 20 bp, Artificial sequence
  Synthetic oligonucleotide
gcttgccaggtgagcttctg

SEQ ID NO: 2936 - DNA, 20 bp, Artificial sequence
  Synthetic oligonucleotide
tctttgcttgccaggtgagc

SEQ ID NO: 2937 - DNA, 20 bp, Artificial sequence
  Synthetic oligonucleotide
tccagggagagaccaacagg

SEQ ID NO: 2938 - DNA, 20 bp, Artificial sequence
  Synthetic oligonucleotide
tctggtccagggagagacca

SEQ ID NO: 2939 - DNA, 20 bp, Artificial sequence
  Synthetic oligonucleotide
aaatctctggtccagggaga

SEQ ID NO: 2940 - DNA, 20 bp, Artificial sequence
  Synthetic oligonucleotide
gtgaaaaatctctggtccag

SEQ ID NO: 2941 - DNA, 20 bp, Artificial sequence
  Synthetic oligonucleotide
aagtggtgaaaaatctctgg

SEQ ID NO: 2942 - DNA, 20 bp, Artificial sequence
  Synthetic oligonucleotide
gcacaaagtggtgaaaaatc

SEQ ID NO: 2943 - DNA, 20 bp, Artificial sequence
  Synthetic oligonucleotide
ccatggcacaaagtggtgaa

SEQ ID NO: 2944 - DNA, 20 bp, Artificial sequence
  Synthetic oligonucleotide
gggttccatggcacaaagtg

SEQ ID NO: 2945 - DNA, 20 bp, Artificial sequence
  Synthetic oligonucleotide
attaaatactctaaaacact

SEQ ID NO: 2946 - DNA, 20 bp, Artificial sequence
  Synthetic oligonucleotide
cttgtattaaatactctaaa

SEQ ID NO: 2947 - DNA, 20 bp, Artificial sequence
  Synthetic oligonucleotide
tgcaccttgtattaaatact

SEQ ID NO: 2948 - DNA, 20 bp, Artificial sequence
  Synthetic oligonucleotide
tccaatgcaccttgtattaa

SEQ ID NO: 2949 - DNA, 20 bp, Artificial sequence
  Synthetic oligonucleotide
tgaaatccaatgcaccttgt

SEQ ID NO: 2950 - DNA, 20 bp, Artificial sequence
  Synthetic oligonucleotide
tcctttgaaatccaatgcac

SEQ ID NO: 2951 - DNA, 20 bp, Artificial sequence
  Synthetic oligonucleotide
tagtttcctttgaaatccaa

SEQ ID NO: 2952 - DNA, 20 bp, Artificial sequence
  Synthetic oligonucleotide
tgttactacatgtctaatca

SEQ ID NO: 2953 - DNA, 20 bp, Artificial sequence
  Synthetic oligonucleotide
gcacctgttactacatgtct

SEQ ID NO: 2954 - DNA, 20 bp, Artificial sequence
  Synthetic oligonucleotide
aaaaggcacctgttactaca

SEQ ID NO: 2955 - DNA, 20 bp, Artificial sequence
  Synthetic oligonucleotide
taataaaaaggcacctgtta

SEQ ID NO: 2956 - DNA, 20 bp, Artificial sequence
  Synthetic oligonucleotide
aaataacaaaggtattttca

SEQ ID NO: 2957 - DNA, 20 bp, Artificial sequence
  Synthetic oligonucleotide
caaataaataacaaaggtat

SEQ ID NO: 2958 - DNA, 20 bp, Artificial sequence
  Synthetic oligonucleotide
tgacacaaataaataacaaa

SEQ ID NO: 2959 - DNA, 20 bp, Artificial sequence
  Synthetic oligonucleotide
tcacagaattatcagcagta

SEQ ID NO: 2960 - DNA, 20 bp, Artificial sequence
  Synthetic oligonucleotide
ataaatcacagaattatcag

SEQ ID NO: 2961 - DNA, 20 bp, Artificial sequence
  Synthetic oligonucleotide
catttccttcacttaccaat

SEQ ID NO: 2962 - DNA, 20 bp, Artificial sequence
  Synthetic oligonucleotide
cacttatctcttatggaaat

SEQ ID NO: 2963 - DNA, 20 bp, Artificial sequence
  Synthetic oligonucleotide
attttcacttatctcttatg

SEQ ID NO: 2964 - DNA, 20 bp, Artificial sequence
  Synthetic oligonucleotide
tctaaattttcacttatctc

SEQ ID NO: 2965 - DNA, 20 bp, Artificial sequence
  Synthetic oligonucleotide
tgacatctaaattttcactt

SEQ ID NO: 2966 - DNA, 20 bp, Artificial sequence
  Synthetic oligonucleotide
acaaatgacatctaaatttt

SEQ ID NO: 2967 - DNA, 20 bp, Artificial sequence
  Synthetic oligonucleotide
gggaaacaaatgacatctaa

SEQ ID NO: 2968 - DNA, 20 bp, Artificial sequence
  Synthetic oligonucleotide
acacaatatccatggacttg

SEQ ID NO: 2969 - DNA, 20 bp, Artificial sequence
  Synthetic oligonucleotide
ctgacacacaatatccatgg

SEQ ID NO: 2970 - DNA, 20 bp, Artificial sequence
  Synthetic oligonucleotide
atttccttacagggtattgg

SEQ ID NO: 2971 - DNA, 20 bp, Artificial sequence
  Synthetic oligonucleotide
ggccaagccccattcctaag

SEQ ID NO: 2972 - DNA, 20 bp, Artificial sequence
  Synthetic oligonucleotide
ttgctggccaagccccattc

SEQ ID NO: 2973 - DNA, 20 bp, Artificial sequence
  Synthetic oligonucleotide
gccacttgctggccaagccc

SEQ ID NO: 2974 - DNA, 20 bp, Artificial sequence
  Synthetic oligonucleotide
ggtgaagagcatggactctg

SEQ ID NO: 2975 - DNA, 20 bp, Artificial sequence
  Synthetic oligonucleotide
gcagggaaggcagcagtgtg

SEQ ID NO: 2976 - DNA, 20 bp, Artificial sequence
  Synthetic oligonucleotide
caatggcagggaaggcagca

SEQ ID NO: 2977 - DNA, 20 bp, Artificial sequence
  Synthetic oligonucleotide
acttgtgatacaaaattctg

SEQ ID NO: 2978 - DNA, 20 bp, Artificial sequence
  Synthetic oligonucleotide
aagacacttgtgatacaaaa

SEQ ID NO: 2979 - DNA, 20 bp, Artificial sequence
  Synthetic oligonucleotide
aagcttagaaggccctgctt

SEQ ID NO: 2980 - DNA, 20 bp, Artificial sequence
  Synthetic oligonucleotide
atgagaagcttagaaggccc

SEQ ID NO: 2981 - DNA, 20 bp, Artificial sequence
  Synthetic oligonucleotide
agctcatgagaagcttagaa

SEQ ID NO: 2982 - DNA, 20 bp, Artificial sequence
  Synthetic oligonucleotide
tgctgagctcatgagaagct

SEQ ID NO: 2983 - DNA, 20 bp, Artificial sequence
  Synthetic oligonucleotide
actgttgctgagctcatgag

SEQ ID NO: 2984 - DNA, 20 bp, Artificial sequence
  Synthetic oligonucleotide
aaaccactgttgctgagctc

SEQ ID NO: 2985 - DNA, 20 bp, Artificial sequence
  Synthetic oligonucleotide
agtaaaaaccactgttgctg

SEQ ID NO: 2986 - DNA, 20 bp, Artificial sequence
  Synthetic oligonucleotide
gctgcagtaaaaaccactgt

SEQ ID NO: 2987 - DNA, 20 bp, Artificial sequence
  Synthetic oligonucleotide
ctggttccatgctcttaggt

SEQ ID NO: 2988 - DNA, 20 bp, Artificial sequence
  Synthetic oligonucleotide
aggctctggttccatgctct

SEQ ID NO: 2989 - DNA, 20 bp, Artificial sequence
  Synthetic oligonucleotide
acaacaggctctggttccat

SEQ ID NO: 2990 - DNA, 20 bp, Artificial sequence
  Synthetic oligonucleotide
tctgaacaacaggctctggt

SEQ ID NO: 2991 - DNA, 20 bp, Artificial sequence
  Synthetic oligonucleotide
tgtcctctgaacaacaggct

SEQ ID NO: 2992 - DNA, 20 bp, Artificial sequence
  Synthetic oligonucleotide
atccttgtcctctgaacaac

SEQ ID NO: 2993 - DNA, 20 bp, Artificial sequence
  Synthetic oligonucleotide
gcctaatccttgtcctctga

SEQ ID NO: 2994 - DNA, 20 bp, Artificial sequence
  Synthetic oligonucleotide
tcagagcctaatccttgtcc

SEQ ID NO: 2995 - DNA, 20 bp, Artificial sequence
  Synthetic oligonucleotide
ctttctcagagcctaatcct

SEQ ID NO: 2996 - DNA, 20 bp, Artificial sequence
  Synthetic oligonucleotide
ccttcctttctcagagccta

SEQ ID NO: 2997 - DNA, 20 bp, Artificial sequence
  Synthetic oligonucleotide
aatgaccttcctttctcaga

SEQ ID NO: 2998 - DNA, 20 bp, Artificial sequence
  Synthetic oligonucleotide
caccaaatgaccttcctttc

SEQ ID NO: 2999 - DNA, 20 bp, Artificial sequence
  Synthetic oligonucleotide
aaatccaccaaatgaccttc

SEQ ID NO: 3000 - DNA, 20 bp, Artificial sequence
  Synthetic oligonucleotide
gaactaaatccaccaaatga

SEQ ID NO: 3001 - DNA, 20 bp, Artificial sequence
  Synthetic oligonucleotide
aggatgaactaaatccacca

SEQ ID NO: 3002 - DNA, 20 bp, Artificial sequence
  Synthetic oligonucleotide
gcaaaaggatgaactaaatc

SEQ ID NO: 3003 - DNA, 20 bp, Artificial sequence
  Synthetic oligonucleotide
gaagagcaaaaggatgaact

SEQ ID NO: 3004 - DNA, 20 bp, Artificial sequence
  Synthetic oligonucleotide
cacaggaagagcaaaaggat

SEQ ID NO: 3005 - DNA, 20 bp, Artificial sequence
  Synthetic oligonucleotide
ccaaacacaggaagagcaaa

SEQ ID NO: 3006 - DNA, 20 bp, Artificial sequence
  Synthetic oligonucleotide
agaaaccaaacacaggaaga

SEQ ID NO: 3007 - DNA, 20 bp, Artificial sequence
  Synthetic oligonucleotide
gccccagaaaccaaacacag

SEQ ID NO: 3008 - DNA, 20 bp, Artificial sequence
  Synthetic oligonucleotide
ctccagccccagaaaccaaa

SEQ ID NO: 3009 - DNA, 20 bp, Artificial sequence
  Synthetic oligonucleotide
aatctctccagccccagaaa

SEQ ID NO: 3010 - DNA, 20 bp, Artificial sequence
  Synthetic oligonucleotide
cctggcctttctcagctggg

SEQ ID NO: 3011 - DNA, 20 bp, Artificial sequence
  Synthetic oligonucleotide
tctagcctggcctttctcag

SEQ ID NO: 3012 - DNA, 20 bp, Artificial sequence
  Synthetic oligonucleotide
tgaattctagcctggccttt

SEQ ID NO: 3013 - DNA, 20 bp, Artificial sequence
  Synthetic oligonucleotide
gagactgaattctagcctgg

SEQ ID NO: 3014 - DNA, 20 bp, Artificial sequence
  Synthetic oligonucleotide
atccagagactgaattctag

SEQ ID NO: 3015 - DNA, 20 bp, Artificial sequence
  Synthetic oligonucleotide
agaagaagaggcctgatggg

SEQ ID NO: 3016 - DNA, 20 bp, Artificial sequence
  Synthetic oligonucleotide
gatggagaagaagaggcctg

SEQ ID NO: 3017 - DNA, 20 bp, Artificial sequence
  Synthetic oligonucleotide
gcctggatggagaagaagag

SEQ ID NO: 3018 - DNA, 20 bp, Artificial sequence
  Synthetic oligonucleotide
aggcagcctggatggagaag

SEQ ID NO: 3019 - DNA, 20 bp, Artificial sequence
  Synthetic oligonucleotide
tgctgaggcagcctggatgg

SEQ ID NO: 3020 - DNA, 20 bp, Artificial sequence
  Synthetic oligonucleotide
tctgctgctgaggcagcctg

SEQ ID NO: 3021 - DNA, 20 bp, Artificial sequence
  Synthetic oligonucleotide
cttactctgctgctgaggca

SEQ ID NO: 3022 - DNA, 20 bp, Artificial sequence
  Synthetic oligonucleotide
ttgtccttactctgctgctg

SEQ ID NO: 3023 - DNA, 20 bp, Artificial sequence
  Synthetic oligonucleotide
ggctggtctctctgggaagg

SEQ ID NO: 3024 - DNA, 20 bp, Artificial sequence
  Synthetic oligonucleotide
tagagggctggtctctctgg

SEQ ID NO: 3025 - DNA, 20 bp, Artificial sequence
  Synthetic oligonucleotide
ctgcttagagggctggtctc

SEQ ID NO: 3026 - DNA, 20 bp, Artificial sequence
  Synthetic oligonucleotide
ccccactgcttagagggctg

SEQ ID NO: 3027 - DNA, 20 bp, Artificial sequence
  Synthetic oligonucleotide
ccaggccccactgcttagag

SEQ ID NO: 3028 - DNA, 20 bp, Artificial sequence
  Synthetic oligonucleotide
gagctccaggccccactgct

SEQ ID NO: 3029 - DNA, 20 bp, Artificial sequence
  Synthetic oligonucleotide
ggaaacctagcttccagaaa

SEQ ID NO: 3030 - DNA, 20 bp, Artificial sequence
  Synthetic oligonucleotide
tttaggctatggtctgagca

SEQ ID NO: 3031 - DNA, 20 bp, Artificial sequence
  Synthetic oligonucleotide
tgaggtttaggctatggtct

SEQ ID NO: 3032 - DNA, 20 bp, Artificial sequence
  Synthetic oligonucleotide
gatgctccaggtgggccaga

SEQ ID NO: 3033 - DNA, 20 bp, Artificial sequence
  Synthetic oligonucleotide
aggtggatgctccaggtggg

SEQ ID NO: 3034 - DNA, 20 bp, Artificial sequence
  Synthetic oligonucleotide
cctctaggtggatgctccag

SEQ ID NO: 3035 - DNA, 20 bp, Artificial sequence
  Synthetic oligonucleotide
ggcatcctctaggtggatgc

SEQ ID NO: 3036 - DNA, 20 bp, Artificial sequence
  Synthetic oligonucleotide
ctagtggcatcctctaggtg

SEQ ID NO: 3037 - DNA, 20 bp, Artificial sequence
  Synthetic oligonucleotide
ctcctctagtggcatcctct

SEQ ID NO: 3038 - DNA, 20 bp, Artificial sequence
  Synthetic oligonucleotide
ccaggctcctctagtggcat

SEQ ID NO: 3039 - DNA, 20 bp, Artificial sequence
  Synthetic oligonucleotide
ggcatccaggctcctctagt

SEQ ID NO: 3040 - DNA, 20 bp, Artificial sequence
  Synthetic oligonucleotide
gactctagccccccagactc

SEQ ID NO: 3041 - DNA, 20 bp, Artificial sequence
  Synthetic oligonucleotide
tctgcctgattccctttctt

SEQ ID NO: 3042 - DNA, 20 bp, Artificial sequence
  Synthetic oligonucleotide
agcagtctgcctgattccct

SEQ ID NO: 3043 - DNA, 20 bp, Artificial sequence
  Synthetic oligonucleotide
tgttcagcagtctgcctgat

SEQ ID NO: 3044 - DNA, 20 bp, Artificial sequence
  Synthetic oligonucleotide
cttactgttcagcagtctgc

SEQ ID NO: 3045 - DNA, 20 bp, Artificial sequence
  Synthetic oligonucleotide
tcatacttactgttcagcag

SEQ ID NO: 3046 - DNA, 20 bp, Artificial sequence
  Synthetic oligonucleotide
caaagtcatacttactgttc

SEQ ID NO: 3047 - DNA, 20 bp, Artificial sequence
  Synthetic oligonucleotide
gcctacaaagtcatacttac

SEQ ID NO: 3048 - DNA, 20 bp, Artificial sequence
  Synthetic oligonucleotide
ggtgaatagctatgtctaaa

SEQ ID NO: 3049 - DNA, 20 bp, Artificial sequence
  Synthetic oligonucleotide
agcttggtgaatagctatgt

SEQ ID NO: 3050 - DNA, 20 bp, Artificial sequence
  Synthetic oligonucleotide
agcaaactgtgaaaagctta

SEQ ID NO: 3051 - DNA, 20 bp, Artificial sequence
  Synthetic oligonucleotide
ttaaaagcaaactgtgaaaa

SEQ ID NO: 3052 - DNA, 20 bp, Artificial sequence
  Synthetic oligonucleotide
gcctgttaaaagcaaactgt

SEQ ID NO: 3053 - DNA, 20 bp, Artificial sequence
  Synthetic oligonucleotide
caagagcctgttaaaagcaa

SEQ ID NO: 3054 - DNA, 20 bp, Artificial sequence
  Synthetic oligonucleotide
gcctacaagagcctgttaaa

SEQ ID NO: 3055 - DNA, 20 bp, Artificial sequence
  Synthetic oligonucleotide
gtgcagcctacaagagcctg

SEQ ID NO: 3056 - DNA, 20 bp, Artificial sequence
  Synthetic oligonucleotide
agcatgtgcagcctacaaga

SEQ ID NO: 3057 - DNA, 20 bp, Artificial sequence
  Synthetic oligonucleotide
agggaagcatgtgcagccta

SEQ ID NO: 3058 - DNA, 20 bp, Artificial sequence
  Synthetic oligonucleotide
tttctagggaagcatgtgca

SEQ ID NO: 3059 - DNA, 20 bp, Artificial sequence
  Synthetic oligonucleotide
acaagtttctagggaagcat

SEQ ID NO: 3060 - DNA, 20 bp, Artificial sequence
  Synthetic oligonucleotide
ggaagacaagtttctaggga

SEQ ID NO: 3061 - DNA, 20 bp, Artificial sequence
  Synthetic oligonucleotide
agaagggaagacaagtttct

SEQ ID NO: 3062 - DNA, 20 bp, Artificial sequence
  Synthetic oligonucleotide
atcgcagaagggaagacaag

SEQ ID NO: 3063 - DNA, 20 bp, Artificial sequence
  Synthetic oligonucleotide
agtgacgagatgtccaattt

SEQ ID NO: 3064 - DNA, 20 bp, Artificial sequence
  Synthetic oligonucleotide
acaactctcttgttgggagg

SEQ ID NO: 3065 - DNA, 20 bp, Artificial sequence
  Synthetic oligonucleotide
agggtacaactctcttgttg

SEQ ID NO: 3066 - DNA, 20 bp, Artificial sequence
  Synthetic oligonucleotide
aaaacagggtacaactctct

SEQ ID NO: 3067 - DNA, 20 bp, Artificial sequence
  Synthetic oligonucleotide
agctaaaaacagggtacaac

SEQ ID NO: 3068 - DNA, 20 bp, Artificial sequence
  Synthetic oligonucleotide
ccagggtagctaaaaacagg

SEQ ID NO: 3069 - DNA, 20 bp, Artificial sequence
  Synthetic oligonucleotide
tctccccagggtagctaaaa

SEQ ID NO: 3070 - DNA, 20 bp, Artificial sequence
  Synthetic oligonucleotide
cagcctctccccagggtagc

SEQ ID NO: 3071 - DNA, 20 bp, Artificial sequence
  Synthetic oligonucleotide
tagccctgttctagactcct

SEQ ID NO: 3072 - DNA, 20 bp, Artificial sequence
  Synthetic oligonucleotide
tagccccttgttgcccccca

SEQ ID NO: 3073 - DNA, 20 bp, Artificial sequence
  Synthetic oligonucleotide
aatggtagccccttgttgcc

SEQ ID NO: 3074 - DNA, 20 bp, Artificial sequence
  Synthetic oligonucleotide
agggaaatggtagccccttg

SEQ ID NO: 3075 - DNA, 20 bp, Artificial sequence
  Synthetic oligonucleotide
gtagactctccatgagccta

SEQ ID NO: 3076 - DNA, 20 bp, Artificial sequence
  Synthetic oligonucleotide
gggcccacaaaccctgagaa

SEQ ID NO: 3077 - DNA, 20 bp, Artificial sequence
  Synthetic oligonucleotide
aggcacacccagggccatgg

SEQ ID NO: 3078 - DNA, 20 bp, Artificial sequence
  Synthetic oligonucleotide
aagctaggcacacccagggc

SEQ ID NO: 3079 - DNA, 20 bp, Artificial sequence
  Synthetic oligonucleotide
gcactaagctaggcacaccc

SEQ ID NO: 3080 - DNA, 20 bp, Artificial sequence
  Synthetic oligonucleotide
ctgtggcactaagctaggca

SEQ ID NO: 3081 - DNA, 20 bp, Artificial sequence
  Synthetic oligonucleotide
gtttactgtggcactaagct

SEQ ID NO: 3082 - DNA, 20 bp, Artificial sequence
  Synthetic oligonucleotide
tgagtgtttactgtggcact

SEQ ID NO: 3083 - DNA, 20 bp, Artificial sequence
  Synthetic oligonucleotide
actgggcttcatctcccctc

SEQ ID NO: 3084 - DNA, 20 bp, Artificial sequence
  Synthetic oligonucleotide
gtcctactgggcttcatctc

SEQ ID NO: 3085 - DNA, 20 bp, Artificial sequence
  Synthetic oligonucleotide
ggcactgcaggccactcctg

SEQ ID NO: 3086 - DNA, 20 bp, Artificial sequence
  Synthetic oligonucleotide
aagggaggccttgcacttac

SEQ ID NO: 3087 - DNA, 20 bp, Artificial sequence
  Synthetic oligonucleotide
gcccttcagcttgtgcaggg

SEQ ID NO: 3088 - DNA, 20 bp, Artificial sequence
  Synthetic oligonucleotide
atgaggcccttcagcttgtg

SEQ ID NO: 3089 - DNA, 20 bp, Artificial sequence
  Synthetic oligonucleotide
tcaggatgaggcccttcagc

SEQ ID NO: 3090 - DNA, 20 bp, Artificial sequence
  Synthetic oligonucleotide
agcactcaggatgaggccct

SEQ ID NO: 3091 - DNA, 20 bp, Artificial sequence
  Synthetic oligonucleotide
acaaagtgggtgttaaaaga

SEQ ID NO: 3092 - DNA, 20 bp, Artificial sequence
  Synthetic oligonucleotide
ttttcacaaagtgggtgtta

SEQ ID NO: 3093 - DNA, 20 bp, Artificial sequence
  Synthetic oligonucleotide
gcttttaacctccccccaaa

SEQ ID NO: 3094 - DNA, 20 bp, Artificial sequence
  Synthetic oligonucleotide
cctcgactgagtgtgaactc

SEQ ID NO: 3095 - DNA, 20 bp, Artificial sequence
  Synthetic oligonucleotide
caaaccctcgactgagtgtg

SEQ ID NO: 3096 - DNA, 20 bp, Artificial sequence
  Synthetic oligonucleotide
ttatgcaaaccctcgactga

SEQ ID NO: 3097 - DNA, 20 bp, Artificial sequence
  Synthetic oligonucleotide
acatttgggcaaggcagaca

SEQ ID NO: 3098 - DNA, 20 bp, Artificial sequence
  Synthetic oligonucleotide
agggaataaaatacagagtt

SEQ ID NO: 3099 - DNA, 20 bp, Artificial sequence
  Synthetic oligonucleotide
cttccagggaataaaataca

SEQ ID NO: 3100 - DNA, 20 bp, Artificial sequence
  Synthetic oligonucleotide
gccaccttccagggaataaa

SEQ ID NO: 3101 - DNA, 20 bp, Artificial sequence
  Synthetic oligonucleotide
ctcctgccaccttccaggga

SEQ ID NO: 3102 - DNA, 20 bp, Artificial sequence
  Synthetic oligonucleotide
gtgacctcctgccaccttcc

SEQ ID NO: 3103 - DNA, 20 bp, Artificial sequence
  Synthetic oligonucleotide
tttacctggatgggaaagta

SEQ ID NO: 3104 - DNA, 20 bp, Artificial sequence
  Synthetic oligonucleotide
cagcactttacctggatggg

SEQ ID NO: 3105 - DNA, 20 bp, Artificial sequence
  Synthetic oligonucleotide
actcacagcactttacctgg

SEQ ID NO: 3106 - DNA, 20 bp, Artificial sequence
  Synthetic oligonucleotide
acaacactcacagcacttta

SEQ ID NO: 3107 - DNA, 20 bp, Artificial sequence
  Synthetic oligonucleotide
acttgcttccctgtgggtgg

SEQ ID NO: 3108 - DNA, 20 bp, Artificial sequence
  Synthetic oligonucleotide
tctaaacttgcttccctgtg

SEQ ID NO: 3109 - DNA, 20 bp, Artificial sequence
  Synthetic oligonucleotide
cttggtctaaacttgcttcc

SEQ ID NO: 3110 - DNA, 20 bp, Artificial sequence
  Synthetic oligonucleotide
accaacttggtctaaacttg

SEQ ID NO: 3111 - DNA, 20 bp, Artificial sequence
  Synthetic oligonucleotide
ggatactcagaagagcagtg

SEQ ID NO: 3112 - DNA, 20 bp, Artificial sequence
  Synthetic oligonucleotide
cctcagggctggcccaaaga

SEQ ID NO: 3113 - DNA, 20 bp, Artificial sequence
  Synthetic oligonucleotide
caggacctcagggctggccc

SEQ ID NO: 3114 - DNA, 20 bp, Artificial sequence
  Synthetic oligonucleotide
cctgtcaggacctcagggct

SEQ ID NO: 3115 - DNA, 20 bp, Artificial sequence
  Synthetic oligonucleotide
atttccctgtcaggacctca

SEQ ID NO: 3116 - DNA, 20 bp, Artificial sequence
  Synthetic oligonucleotide
tgaaagccaaactgagccac

SEQ ID NO: 3117 - DNA, 20 bp, Artificial sequence
  Synthetic oligonucleotide
agcttgcagaccaggcaggg

SEQ ID NO: 3118 - DNA, 20 bp, Artificial sequence
  Synthetic oligonucleotide
agcccagcttgcagaccagg

SEQ ID NO: 3119 - DNA, 20 bp, Artificial sequence
  Synthetic oligonucleotide
tcaccagcccagcttgcaga

SEQ ID NO: 3120 - DNA, 20 bp, Artificial sequence
  Synthetic oligonucleotide
gtgcctcaccagcccagctt

SEQ ID NO: 3121 - DNA, 20 bp, Artificial sequence
  Synthetic oligonucleotide
acatgcatcagggccagatg

SEQ ID NO: 3122 - DNA, 20 bp, Artificial sequence
  Synthetic oligonucleotide
agttatcctcaattcaccag

SEQ ID NO: 3123 - DNA, 20 bp, Artificial sequence
  Synthetic oligonucleotide
gccagagttatcctcaattc

SEQ ID NO: 3124 - DNA, 20 bp, Artificial sequence
  Synthetic oligonucleotide
atcctgccagagttatcctc

SEQ ID NO: 3125 - DNA, 20 bp, Artificial sequence
  Synthetic oligonucleotide
tcaggatcctgccagagtta

SEQ ID NO: 3126 - DNA, 20 bp, Artificial sequence
  Synthetic oligonucleotide
aaccttcaggatcctgccag

SEQ ID NO: 3127 - DNA, 20 bp, Artificial sequence
  Synthetic oligonucleotide
gggaaaaccttcaggatcct

SEQ ID NO: 3128 - DNA, 20 bp, Artificial sequence
  Synthetic oligonucleotide
acaggtctttcccctgtggg

SEQ ID NO: 3129 - DNA, 20 bp, Artificial sequence
  Synthetic oligonucleotide
gccagacaggtctttcccct

SEQ ID NO: 3130 - DNA, 20 bp, Artificial sequence
  Synthetic oligonucleotide
cttcagcacccctaccttct

SEQ ID NO: 3131 - DNA, 20 bp, Artificial sequence
  Synthetic oligonucleotide
ccactcttcagcacccctac

SEQ ID NO: 3132 - DNA, 20 bp, Artificial sequence
  Synthetic oligonucleotide
tgcctccactcttcagcacc

SEQ ID NO: 3133 - DNA, 20 bp, Artificial sequence
  Synthetic oligonucleotide
atatacaccaccctgcaccc

SEQ ID NO: 3134 - DNA, 20 bp, Artificial sequence
  Synthetic oligonucleotide
agcaaatatacaccaccctg

SEQ ID NO: 3135 - DNA, 20 bp, Artificial sequence
  Synthetic oligonucleotide
acaacagcaaatatacacca

SEQ ID NO: 3136 - DNA, 20 bp, Artificial sequence
  Synthetic oligonucleotide
gactcacaacagcaaatata

SEQ ID NO: 3137 - DNA, 20 bp, Artificial sequence
  Synthetic oligonucleotide
tcactgactcacaacagcaa

SEQ ID NO: 3138 - DNA, 20 bp, Artificial sequence
  Synthetic oligonucleotide
ctcagtcactgactcacaac

SEQ ID NO: 3139 - DNA, 20 bp, Artificial sequence
  Synthetic oligonucleotide
aggatctcagtcactgactc

SEQ ID NO: 3140 - DNA, 20 bp, Artificial sequence
  Synthetic oligonucleotide
cacaccaggatctcagtcac

SEQ ID NO: 3141 - DNA, 20 bp, Artificial sequence
  Synthetic oligonucleotide
ccagccactgcccccaggca

SEQ ID NO: 3142 - DNA, 20 bp, Artificial sequence
  Synthetic oligonucleotide
gttacccagccactgccccc

SEQ ID NO: 3143 - DNA, 20 bp, Artificial sequence
  Synthetic oligonucleotide
gcagggttacccagccactg

SEQ ID NO: 3144 - DNA, 20 bp, Artificial sequence
  Synthetic oligonucleotide
aggatgcagggttacccagc

SEQ ID NO: 3145 - DNA, 20 bp, Artificial sequence
  Synthetic oligonucleotide
agtgaaggatgcagggttac

SEQ ID NO: 3146 - DNA, 20 bp, Artificial sequence
  Synthetic oligonucleotide
aatgcagtgaaggatgcagg

SEQ ID NO: 3147 - DNA, 20 bp, Artificial sequence
  Synthetic oligonucleotide
aggagctggccctgccaccc

SEQ ID NO: 3148 - DNA, 20 bp, Artificial sequence
  Synthetic oligonucleotide
gcagaaggagctggccctgc

SEQ ID NO: 3149 - DNA, 20 bp, Artificial sequence
  Synthetic oligonucleotide
gatgagcagaaggagctggc

SEQ ID NO: 3150 - DNA, 20 bp, Artificial sequence
  Synthetic oligonucleotide
ctaaggatgagcagaaggag

SEQ ID NO: 3151 - DNA, 20 bp, Artificial sequence
  Synthetic oligonucleotide
ttaggctaaggatgagcaga

SEQ ID NO: 3152 - DNA, 20 bp, Artificial sequence
  Synthetic oligonucleotide
tgggcttaggctaaggatga

SEQ ID NO: 3153 - DNA, 20 bp, Artificial sequence
  Synthetic oligonucleotide
tcttcattacatgattactg

SEQ ID NO: 3154 - DNA, 20 bp, Artificial sequence
  Synthetic oligonucleotide
gcagatcttcattacatgat

SEQ ID NO: 3155 - DNA, 20 bp, Artificial sequence
  Synthetic oligonucleotide
accaggaagggagtaggtgg

SEQ ID NO: 3156 - DNA, 20 bp, Artificial sequence
  Synthetic oligonucleotide
gtcccaccaggaagggagta

SEQ ID NO: 3157 - DNA, 20 bp, Artificial sequence
  Synthetic oligonucleotide
ccagagtcccaccaggaagg

SEQ ID NO: 3158 - DNA, 20 bp, Artificial sequence
  Synthetic oligonucleotide
aaagaccagagtcccaccag

SEQ ID NO: 3159 - DNA, 20 bp, Artificial sequence
  Synthetic oligonucleotide
gggccagatgagctgttctg

SEQ ID NO: 3160 - DNA, 20 bp, Artificial sequence
  Synthetic oligonucleotide
gtgccaacagaagggataca

SEQ ID NO: 3161 - DNA, 20 bp, Artificial sequence
  Synthetic oligonucleotide
cacctgtgccaacagaaggg

SEQ ID NO: 3162 - DNA, 20 bp, Artificial sequence
  Synthetic oligonucleotide
aaccccacctgtgccaacag

SEQ ID NO: 3163 - DNA, 20 bp, Artificial sequence
  Synthetic oligonucleotide
ggctggtggtctcggtggct

SEQ ID NO: 3164 - DNA, 20 bp, Artificial sequence
  Synthetic oligonucleotide
caggtggctggtggtctcgg

SEQ ID NO: 3165 - DNA, 20 bp, Artificial sequence
  Synthetic oligonucleotide
tcttccaggtggctggtggt

SEQ ID NO: 3166 - DNA, 20 bp, Artificial sequence
  Synthetic oligonucleotide
gctcctcttccaggtggctg

SEQ ID NO: 3167 - DNA, 20 bp, Artificial sequence
  Synthetic oligonucleotide
tgtctgctcctcttccaggt

SEQ ID NO: 3168 - DNA, 20 bp, Artificial sequence
  Synthetic oligonucleotide
ggcactgtctgctcctcttc

SEQ ID NO: 3169 - DNA, 20 bp, Artificial sequence
  Synthetic oligonucleotide
ttcctagtctcctctccaag

SEQ ID NO: 3170 - DNA, 20 bp, Artificial sequence
  Synthetic oligonucleotide
attctaagcttagagagagt

SEQ ID NO: 3171 - DNA, 20 bp, Artificial sequence
  Synthetic oligonucleotide
aggtgattctaagcttagag

SEQ ID NO: 3172 - DNA, 20 bp, Artificial sequence
  Synthetic oligonucleotide
tggacaggtgattctaagct

SEQ ID NO: 3173 - DNA, 20 bp, Artificial sequence
  Synthetic oligonucleotide
gcagatggacaggtgattct

SEQ ID NO: 3174 - DNA, 20 bp, Artificial sequence
  Synthetic oligonucleotide
atgaggcagatggacaggtg

SEQ ID NO: 3175 - DNA, 20 bp, Artificial sequence
  Synthetic oligonucleotide
gtgaaatgaggcagatggac

SEQ ID NO: 3176 - DNA, 20 bp, Artificial sequence
  Synthetic oligonucleotide
tatcagtgaaatgaggcaga

SEQ ID NO: 3177 - DNA, 20 bp, Artificial sequence
  Synthetic oligonucleotide
aagcctatcagtgaaatgag

SEQ ID NO: 3178 - DNA, 20 bp, Artificial sequence
  Synthetic oligonucleotide
tcagtaagcctatcagtgaa

SEQ ID NO: 3179 - DNA, 20 bp, Artificial sequence
  Synthetic oligonucleotide
gtgcctcagtaagcctatca

SEQ ID NO: 3180 - DNA, 20 bp, Artificial sequence
  Synthetic oligonucleotide
tctctgtgcctcagtaagcc

SEQ ID NO: 3181 - DNA, 20 bp, Artificial sequence
  Synthetic oligonucleotide
tgaccttgggatagtccctc

SEQ ID NO: 3182 - DNA, 20 bp, Artificial sequence
  Synthetic oligonucleotide
ctttgtgaccttgggatagt

SEQ ID NO: 3183 - DNA, 20 bp, Artificial sequence
  Synthetic oligonucleotide
cttaagctttgtgaccttgg

SEQ ID NO: 3184 - DNA, 20 bp, Artificial sequence
  Synthetic oligonucleotide
tactacttaagctttgtgac

SEQ ID NO: 3185 - DNA, 20 bp, Artificial sequence
  Synthetic oligonucleotide
cctgctactacttaagcttt

SEQ ID NO: 3186 - DNA, 20 bp, Artificial sequence
  Synthetic oligonucleotide
ctagtcctgctactacttaa

SEQ ID NO: 3187 - DNA, 20 bp, Artificial sequence
  Synthetic oligonucleotide
ctacactagtcctgctacta

SEQ ID NO: 3188 - DNA, 20 bp, Artificial sequence
  Synthetic oligonucleotide
ggttcctacactagtcctgc

SEQ ID NO: 3189 - DNA, 20 bp, Artificial sequence
  Synthetic oligonucleotide
caggagtaagaccatgggcc

SEQ ID NO: 3190 - DNA, 20 bp, Artificial sequence
  Synthetic oligonucleotide
taacacaggagtaagaccat

SEQ ID NO: 3191 - DNA, 20 bp, Artificial sequence
  Synthetic oligonucleotide
gaaagtaacacaggagtaag

SEQ ID NO: 3192 - DNA, 20 bp, Artificial sequence
  Synthetic oligonucleotide
atggtgaaagtaacacagga

SEQ ID NO: 3193 - DNA, 20 bp, Artificial sequence
  Synthetic oligonucleotide
tgcttaagtttacacagcac

SEQ ID NO: 3194 - DNA, 20 bp, Artificial sequence
  Synthetic oligonucleotide
aggcttgcttaagtttacac

SEQ ID NO: 3195 - DNA, 20 bp, Artificial sequence
  Synthetic oligonucleotide
agcaaaggcttgcttaagtt

SEQ ID NO: 3196 - DNA, 20 bp, Artificial sequence
  Synthetic oligonucleotide
agaagagcaaaggcttgctt

SEQ ID NO: 3197 - DNA, 20 bp, Artificial sequence
  Synthetic oligonucleotide
cccacagaagagcaaaggct

SEQ ID NO: 3198 - DNA, 20 bp, Artificial sequence
  Synthetic oligonucleotide
tcagacccacagaagagcaa

SEQ ID NO: 3199 - DNA, 20 bp, Artificial sequence
  Synthetic oligonucleotide
agcagtgcatagaggaaaaa

SEQ ID NO: 3200 - DNA, 20 bp, Artificial sequence
  Synthetic oligonucleotide
accacagcagtgcatagagg

SEQ ID NO: 3201 - DNA, 20 bp, Artificial sequence
  Synthetic oligonucleotide
gtcccaccacagcagtgcat

SEQ ID NO: 3202 - DNA, 20 bp, Artificial sequence
  Synthetic oligonucleotide
ggcttgtcccaccacagcag

SEQ ID NO: 3203 - DNA, 20 bp, Artificial sequence
  Synthetic oligonucleotide
agataggcttgtcccaccac

SEQ ID NO: 3204 - DNA, 20 bp, Artificial sequence
  Synthetic oligonucleotide
tgctcagataggcttgtccc

SEQ ID NO: 3205 - DNA, 20 bp, Artificial sequence
  Synthetic oligonucleotide
caagtcactctttataccct

SEQ ID NO: 3206 - DNA, 20 bp, Artificial sequence
  Synthetic oligonucleotide
cctatcaagtcactctttat

SEQ ID NO: 3207 - DNA, 20 bp, Artificial sequence
  Synthetic oligonucleotide
acattcctatcaagtcactc

SEQ ID NO: 3208 - DNA, 20 bp, Artificial sequence
  Synthetic oligonucleotide
cccaacacgatgcccaggcc

SEQ ID NO: 3209 - DNA, 20 bp, Artificial sequence
  Synthetic oligonucleotide
tcctcttgctgcctgtttcc

SEQ ID NO: 3210 - DNA, 20 bp, Artificial sequence
  Synthetic oligonucleotide
ttgtgtcctcttgctgcctg

SEQ ID NO: 3211 - DNA, 20 bp, Artificial sequence
  Synthetic oligonucleotide
tgctcttgtgtcctcttgct

SEQ ID NO: 3212 - DNA, 20 bp, Artificial sequence
  Synthetic oligonucleotide
aaggataccgccaatgaagg

SEQ ID NO: 3213 - DNA, 20 bp, Artificial sequence
  Synthetic oligonucleotide
tcatgtcacactcccctccc

SEQ ID NO: 3214 - DNA, 20 bp, Artificial sequence
  Synthetic oligonucleotide
catctgaccagctctgatct

SEQ ID NO: 3215 - DNA, 20 bp, Artificial sequence
  Synthetic oligonucleotide
gtaggcatctgaccagctct

SEQ ID NO: 3216 - DNA, 20 bp, Artificial sequence
  Synthetic oligonucleotide
agaatgtaggcatctgacca

SEQ ID NO: 3217 - DNA, 20 bp, Artificial sequence
  Synthetic oligonucleotide
tgcccttgctgtaggaccca

SEQ ID NO: 3218 - DNA, 20 bp, Artificial sequence
  Synthetic oligonucleotide
gtcaatgcccttgctgtagg

SEQ ID NO: 3219 - DNA, 20 bp, Artificial sequence
  Synthetic oligonucleotide
tgcaagtcaatgcccttgct

SEQ ID NO: 3220 - DNA, 20 bp, Artificial sequence
  Synthetic oligonucleotide
cacagtgcaagtcaatgccc

SEQ ID NO: 3221 - DNA, 20 bp, Artificial sequence
  Synthetic oligonucleotide
tgggacacagtgcaagtcaa

SEQ ID NO: 3222 - DNA, 20 bp, Artificial sequence
  Synthetic oligonucleotide
aggctctgatgggacatttg

SEQ ID NO: 3223 - DNA, 20 bp, Artificial sequence
  Synthetic oligonucleotide
caggtggctctttaaatcat

SEQ ID NO: 3224 - DNA, 20 bp, Artificial sequence
  Synthetic oligonucleotide
ggccccaggtggctctttaa

SEQ ID NO: 3225 - DNA, 20 bp, Artificial sequence
  Synthetic oligonucleotide
ccagtgggccccaggtggct

SEQ ID NO: 3226 - DNA, 20 bp, Artificial sequence
  Synthetic oligonucleotide
gtcacccagtgggccccagg

SEQ ID NO: 3227 - DNA, 20 bp, Artificial sequence
  Synthetic oligonucleotide
cctgggctgctggatgaaga

SEQ ID NO: 3228 - DNA, 20 bp, Artificial sequence
  Synthetic oligonucleotide
ttttccctgggctgctggat

SEQ ID NO: 3229 - DNA, 20 bp, Artificial sequence
  Synthetic oligonucleotide
tgcacttttccctgggctgc

SEQ ID NO: 3230 - DNA, 20 bp, Artificial sequence
  Synthetic oligonucleotide
tcacagcaaattatcctgca

SEQ ID NO: 3231 - DNA, 20 bp, Artificial sequence
  Synthetic oligonucleotide
ggaggtcacagcaaattatc

SEQ ID NO: 3232 - DNA, 20 bp, Artificial sequence
  Synthetic oligonucleotide
cctgtggaggtcacagcaaa

SEQ ID NO: 3233 - DNA, 20 bp, Artificial sequence
  Synthetic oligonucleotide
taagccattccttggatgac

SEQ ID NO: 3234 - DNA, 20 bp, Artificial sequence
  Synthetic oligonucleotide
aggtctaagccattccttgg

SEQ ID NO: 3235 - DNA, 20 bp, Artificial sequence
  Synthetic oligonucleotide
ctgaaaggtctaagccattc

SEQ ID NO: 3236 - DNA, 20 bp, Artificial sequence
  Synthetic oligonucleotide
tttgtccccttcctatggct

SEQ ID NO: 3237 - DNA, 20 bp, Artificial sequence
  Synthetic oligonucleotide
caggcctgggatagttaccc

SEQ ID NO: 3238 - DNA, 20 bp, Artificial sequence
  Synthetic oligonucleotide
atggccaggcctgggatagt

SEQ ID NO: 3239 - DNA, 20 bp, Artificial sequence
  Synthetic oligonucleotide
agctgatggccaggcctggg

SEQ ID NO: 3240 - DNA, 20 bp, Artificial sequence
  Synthetic oligonucleotide
tcctgagctgatggccaggc

SEQ ID NO: 3241 - DNA, 20 bp, Artificial sequence
  Synthetic oligonucleotide
cttgctcctgagctgatggc

SEQ ID NO: 3242 - DNA, 20 bp, Artificial sequence
  Synthetic oligonucleotide
ggaaacttgctcctgagctg

SEQ ID NO: 3243 - DNA, 20 bp, Artificial sequence
  Synthetic oligonucleotide
aacttggaaacttgctcctg

SEQ ID NO: 3244 - DNA, 20 bp, Artificial sequence
  Synthetic oligonucleotide
tgggaaacttggaaacttgc

SEQ ID NO: 3245 - DNA, 20 bp, Artificial sequence
  Synthetic oligonucleotide
ggcattgagggaagagctgg

SEQ ID NO: 3246 - DNA, 20 bp, Artificial sequence
  Synthetic oligonucleotide
aggcaggcattgagggaaga

SEQ ID NO: 3247 - DNA, 20 bp, Artificial sequence
  Synthetic oligonucleotide
aaggcaggcaggcattgagg

SEQ ID NO: 3248 - DNA, 20 bp, Artificial sequence
  Synthetic oligonucleotide
tgaaaaaggcaggcaggcat

SEQ ID NO: 3249 - DNA, 20 bp, Artificial sequence
  Synthetic oligonucleotide
tttgatgaaaaaggcaggca

SEQ ID NO: 3250 - DNA, 20 bp, Artificial sequence
  Synthetic oligonucleotide
ctagttttgatgaaaaaggc

SEQ ID NO: 3251 - DNA, 20 bp, Artificial sequence
  Synthetic oligonucleotide
ttgtgctagttttgatgaaa

SEQ ID NO: 3252 - DNA, 20 bp, Artificial sequence
  Synthetic oligonucleotide
tagctctcagtgaagctgga

SEQ ID NO: 3253 - DNA, 20 bp, Artificial sequence
  Synthetic oligonucleotide
gagcagatctcaaaatctcg

SEQ ID NO: 3254 - DNA, 20 bp, Artificial sequence
  Synthetic oligonucleotide
acagcagcagtctaatccat

SEQ ID NO: 3255 - DNA, 20 bp, Artificial sequence
  Synthetic oligonucleotide
gggaaacagcagcagtctaa

SEQ ID NO: 3256 - DNA, 20 bp, Artificial sequence
  Synthetic oligonucleotide
taaatgggaaacagcagcag

SEQ ID NO: 3257 - DNA, 20 bp, Artificial sequence
  Synthetic oligonucleotide
ccaaataaatgggaaacagc

SEQ ID NO: 3258 - DNA, 20 bp, Artificial sequence
  Synthetic oligonucleotide
actccccaaataaatgggaa

SEQ ID NO: 3259 - DNA, 20 bp, Artificial sequence
  Synthetic oligonucleotide
cagctactccccaaataaat

SEQ ID NO: 3260 - DNA, 20 bp, Artificial sequence
  Synthetic oligonucleotide
actctcagctactccccaaa

SEQ ID NO: 3261 - DNA, 20 bp, Artificial sequence
  Synthetic oligonucleotide
aaccaactctcagctactcc

SEQ ID NO: 3262 - DNA, 20 bp, Artificial sequence
  Synthetic oligonucleotide
caaacagattaaagttgctc

SEQ ID NO: 3263 - DNA, 20 bp, Artificial sequence
  Synthetic oligonucleotide
aatgtgagcaagactccctc

SEQ ID NO: 3264 - DNA, 20 bp, Artificial sequence
  Synthetic oligonucleotide
ttgggagcctcctggcagag

SEQ ID NO: 3265 - DNA, 20 bp, Artificial sequence
  Synthetic oligonucleotide
gcccaggttttctgtgactc

SEQ ID NO: 3266 - DNA, 20 bp, Artificial sequence
  Synthetic oligonucleotide
caagagcccaggttttctgt

SEQ ID NO: 3267 - DNA, 20 bp, Artificial sequence
  Synthetic oligonucleotide
gtcactggccaccagcagaa

SEQ ID NO: 3268 - DNA, 20 bp, Artificial sequence
  Synthetic oligonucleotide
gcagagtcactggccaccag

SEQ ID NO: 3269 - DNA, 20 bp, Artificial sequence
  Synthetic oligonucleotide
tggaagcagagtcactggcc

SEQ ID NO: 3270 - DNA, 20 bp, Artificial sequence
  Synthetic oligonucleotide
tgcaaagtgccccttccctg

SEQ ID NO: 3271 - DNA, 20 bp, Artificial sequence
  Synthetic oligonucleotide
agtgctgcaaagtgcccctt

SEQ ID NO: 3272 - DNA, 20 bp, Artificial sequence
  Synthetic oligonucleotide
acctgagtgctgcaaagtgc

SEQ ID NO: 3273 - DNA, 20 bp, Artificial sequence
  Synthetic oligonucleotide
ctcccacctgagtgctgcaa

SEQ ID NO: 3274 - DNA, 20 bp, Artificial sequence
  Synthetic oligonucleotide
tgacactcccacctgagtgc

SEQ ID NO: 3275 - DNA, 20 bp, Artificial sequence
  Synthetic oligonucleotide
atcaatgacactcccacctg

SEQ ID NO: 3276 - DNA, 20 bp, Artificial sequence
  Synthetic oligonucleotide
ttttggctgccctgcctcaa

SEQ ID NO: 3277 - DNA, 20 bp, Artificial sequence
  Synthetic oligonucleotide
ggtctttttggctgccctgc

SEQ ID NO: 3278 - DNA, 20 bp, Artificial sequence
  Synthetic oligonucleotide
gataacaaggaatgaacacg

SEQ ID NO: 3279 - DNA, 20 bp, Artificial sequence
  Synthetic oligonucleotide
tcctggataacaaggaatga

SEQ ID NO: 3280 - DNA, 20 bp, Artificial sequence
  Synthetic oligonucleotide
tacaattcctggataacaag

SEQ ID NO: 3281 - DNA, 20 bp, Artificial sequence
  Synthetic oligonucleotide
agaaatacaattcctggata

SEQ ID NO: 3282 - DNA, 20 bp, Artificial sequence
  Synthetic oligonucleotide
cttctagaaatacaattcct

SEQ ID NO: 3283 - DNA, 20 bp, Artificial sequence
  Synthetic oligonucleotide
acaaacttctagaaatacaa

SEQ ID NO: 3284 - DNA, 20 bp, Artificial sequence
  Synthetic oligonucleotide
gtgaaacaaacttctagaaa

SEQ ID NO: 3285 - DNA, 20 bp, Artificial sequence
  Synthetic oligonucleotide
tttgtccacatatctgattg

SEQ ID NO: 3286 - DNA, 20 bp, Artificial sequence
  Synthetic oligonucleotide
ttatctttgtccacatatct

SEQ ID NO: 3287 - DNA, 20 bp, Artificial sequence
  Synthetic oligonucleotide
ataccttatctttgtccaca

SEQ ID NO: 3288 - DNA, 20 bp, Artificial sequence
  Synthetic oligonucleotide
aataaataccttatctttgt

SEQ ID NO: 3289 - DNA, 20 bp, Artificial sequence
  Synthetic oligonucleotide
gcttcaataaataccttatc

SEQ ID NO: 3290 - DNA, 20 bp, Artificial sequence
  Synthetic oligonucleotide
gtaatgcttcaataaatacc

SEQ ID NO: 3291 - DNA, 20 bp, Artificial sequence
  Synthetic oligonucleotide
tagaagtaatgcttcaataa

SEQ ID NO: 3292 - DNA, 20 bp, Artificial sequence
  Synthetic oligonucleotide
cctcttagaagtaatgcttc

SEQ ID NO: 3293 - DNA, 20 bp, Artificial sequence
  Synthetic oligonucleotide
atttccctcttagaagtaat

SEQ ID NO: 3294 - DNA, 20 bp, Artificial sequence
  Synthetic oligonucleotide
ccaaaatttccctcttagaa

SEQ ID NO: 3295 - DNA, 20 bp, Artificial sequence
  Synthetic oligonucleotide
tattctacagcacagctctc

SEQ ID NO: 3296 - DNA, 20 bp, Artificial sequence
  Synthetic oligonucleotide
tcaaaatccctcagttccat

SEQ ID NO: 3297 - DNA, 20 bp, Artificial sequence
  Synthetic oligonucleotide
ccttatcaaaatccctcagt

SEQ ID NO: 3298 - DNA, 20 bp, Artificial sequence
  Synthetic oligonucleotide
tctgtccttatcaaaatccc

SEQ ID NO: 3299 - DNA, 20 bp, Artificial sequence
  Synthetic oligonucleotide
agctatctgtccttatcaaa

SEQ ID NO: 3300 - DNA, 20 bp, Artificial sequence
  Synthetic oligonucleotide
atcatttttatatcattttc

SEQ ID NO: 3301 - DNA, 20 bp, Artificial sequence
  Synthetic oligonucleotide
ttgatatcatttttatatca

SEQ ID NO: 3302 - DNA, 20 bp, Artificial sequence
  Synthetic oligonucleotide
atgggttgatatcattttta

SEQ ID NO: 3303 - DNA, 20 bp, Artificial sequence
  Synthetic oligonucleotide
gttatatgggttgatatcat

SEQ ID NO: 3304 - DNA, 20 bp, Artificial sequence
  Synthetic oligonucleotide
ttgaggttatatgggttgat

SEQ ID NO: 3305 - DNA, 20 bp, Artificial sequence
  Synthetic oligonucleotide
caaaattgaggttatatggg

SEQ ID NO: 3306 - DNA, 20 bp, Artificial sequence
  Synthetic oligonucleotide
atacatgctctttttcaaaa

SEQ ID NO: 3307 - DNA, 20 bp, Artificial sequence
  Synthetic oligonucleotide
catctcccaatgcaggccca

SEQ ID NO: 3308 - DNA, 20 bp, Artificial sequence
  Synthetic oligonucleotide
gccctgacccaccatgtctg

SEQ ID NO: 3309 - DNA, 20 bp, Artificial sequence
  Synthetic oligonucleotide
cctcagccctgacccaccat

SEQ ID NO: 3310 - DNA, 20 bp, Artificial sequence
  Synthetic oligonucleotide
ctcctcctcagccctgaccc

SEQ ID NO: 3311 - DNA, 20 bp, Artificial sequence
  Synthetic oligonucleotide
cagctctcctcctcagccct

SEQ ID NO: 3312 - DNA, 20 bp, Artificial sequence
  Synthetic oligonucleotide
atggacagctctcctcctca

SEQ ID NO: 3313 - DNA, 20 bp, Artificial sequence
  Synthetic oligonucleotide
accatatggacagctctcct

SEQ ID NO: 3314 - DNA, 20 bp, Artificial sequence
  Synthetic oligonucleotide
gtgccatggacaacaatcag

SEQ ID NO: 3315 - DNA, 20 bp, Artificial sequence
  Synthetic oligonucleotide
ttacagtgccatggacaaca

SEQ ID NO: 3316 - DNA, 20 bp, Artificial sequence
  Synthetic oligonucleotide
gacaattacagtgccatgga

SEQ ID NO: 3317 - DNA, 20 bp, Artificial sequence
  Synthetic oligonucleotide
aatgcatcagtctggtggga

SEQ ID NO: 3318 - DNA, 20 bp, Artificial sequence
  Synthetic oligonucleotide
atcccaatgcatcagtctgg

SEQ ID NO: 3319 - DNA, 20 bp, Artificial sequence
  Synthetic oligonucleotide
tgcatttggcaaacattccc

SEQ ID NO: 3320 - DNA, 20 bp, Artificial sequence
  Synthetic oligonucleotide
actcatgcatttggcaaaca

SEQ ID NO: 3321 - DNA, 20 bp, Artificial sequence
  Synthetic oligonucleotide
tgggaactcatgcatttggc

SEQ ID NO: 3322 - DNA, 20 bp, Artificial sequence
  Synthetic oligonucleotide
tgttttgggaactcatgcat

SEQ ID NO: 3323 - DNA, 20 bp, Artificial sequence
  Synthetic oligonucleotide
aaggttgttttgggaactca

SEQ ID NO: 3324 - DNA, 20 bp, Artificial sequence
  Synthetic oligonucleotide
gatacaaggttgttttggga

SEQ ID NO: 3325 - DNA, 20 bp, Artificial sequence
  Synthetic oligonucleotide
ctaatgatacaaggttgttt

SEQ ID NO: 3326 - DNA, 20 bp, Artificial sequence
  Synthetic oligonucleotide
tgcagctaatgatacaaggt

SEQ ID NO: 3327 - DNA, 20 bp, Artificial sequence
  Synthetic oligonucleotide
taaaatgcagctaatgatac

SEQ ID NO: 3328 - DNA, 20 bp, Artificial sequence
  Synthetic oligonucleotide
atctgtaaaatgcagctaat

SEQ ID NO: 3329 - DNA, 20 bp, Artificial sequence
  Synthetic oligonucleotide
tcctcatctgtaaaatgcag

SEQ ID NO: 3330 - DNA, 20 bp, Artificial sequence
  Synthetic oligonucleotide
cagtttcctcatctgtaaaa

SEQ ID NO: 3331 - DNA, 20 bp, Artificial sequence
  Synthetic oligonucleotide
agcctcagtttcctcatctg

SEQ ID NO: 3332 - DNA, 20 bp, Artificial sequence
  Synthetic oligonucleotide
ttctgagcctcagtttcctc

SEQ ID NO: 3333 - DNA, 20 bp, Artificial sequence
  Synthetic oligonucleotide
catttttctgagcctcagtt

SEQ ID NO: 3334 - DNA, 20 bp, Artificial sequence
  Synthetic oligonucleotide
ctattcatttttctgagcct

SEQ ID NO: 3335 - DNA, 20 bp, Artificial sequence
  Synthetic oligonucleotide
gtaagctattcatttttctg

SEQ ID NO: 3336 - DNA, 20 bp, Artificial sequence
  Synthetic oligonucleotide
tctgtgtaagctattcattt

SEQ ID NO: 3337 - DNA, 20 bp, Artificial sequence
  Synthetic oligonucleotide
ctggttctgtgtaagctatt

SEQ ID NO: 3338 - DNA, 20 bp, Artificial sequence
  Synthetic oligonucleotide
gttgtctggttctgtgtaag

SEQ ID NO: 3339 - DNA, 20 bp, Artificial sequence
  Synthetic oligonucleotide
ttggagttgtctggttctgt

SEQ ID NO: 3340 - DNA, 20 bp, Artificial sequence
  Synthetic oligonucleotide
tggatccactccccatcccc

SEQ ID NO: 3341 - DNA, 20 bp, Artificial sequence
  Synthetic oligonucleotide
gcccatggatccactcccca

SEQ ID NO: 3342 - DNA, 20 bp, Artificial sequence
  Synthetic oligonucleotide
gggttgcccatggatccact

SEQ ID NO: 3343 - DNA, 20 bp, Artificial sequence
  Synthetic oligonucleotide
agtcagggttgcccatggat

SEQ ID NO: 3344 - DNA, 20 bp, Artificial sequence
  Synthetic oligonucleotide
ccaaggagtctgctgccctg

SEQ ID NO: 3345 - DNA, 20 bp, Artificial sequence
  Synthetic oligonucleotide
gtctgggtcctgtcttcagg

SEQ ID NO: 3346 - DNA, 20 bp, Artificial sequence
  Synthetic oligonucleotide
cagaatgactgactcccttc

SEQ ID NO: 3347 - DNA, 20 bp, Artificial sequence
  Synthetic oligonucleotide
gcagtctgggctccaacatc

SEQ ID NO: 3348 - DNA, 20 bp, Artificial sequence
  Synthetic oligonucleotide
actgtgcagtctgggctcca

SEQ ID NO: 3349 - DNA, 20 bp, Artificial sequence
  Synthetic oligonucleotide
cccacactgtgcagtctggg

SEQ ID NO: 3350 - DNA, 20 bp, Artificial sequence
  Synthetic oligonucleotide
cttggcccacactgtgcagt

SEQ ID NO: 3351 - DNA, 20 bp, Artificial sequence
  Synthetic oligonucleotide
gcaaacttggcccacactgt

SEQ ID NO: 3352 - DNA, 20 bp, Artificial sequence
  Synthetic oligonucleotide
catgggcaaacttggcccac

SEQ ID NO: 3353 - DNA, 20 bp, Artificial sequence
  Synthetic oligonucleotide
acacacatgggcaaacttgg

SEQ ID NO: 3354 - DNA, 20 bp, Artificial sequence
  Synthetic oligonucleotide
cccagacacacatgggcaaa

SEQ ID NO: 3355 - DNA, 20 bp, Artificial sequence
  Synthetic oligonucleotide
gcccacccagacacacatgg

SEQ ID NO: 3356 - DNA, 20 bp, Artificial sequence
  Synthetic oligonucleotide
tctgtgcccacccagacaca

SEQ ID NO: 3357 - DNA, 20 bp, Artificial sequence
  Synthetic oligonucleotide
ttgcatctgtgcccacccag

SEQ ID NO: 3358 - DNA, 20 bp, Artificial sequence
  Synthetic oligonucleotide
acaggttgcatctgtgccca

SEQ ID NO: 3359 - DNA, 20 bp, Artificial sequence
  Synthetic oligonucleotide
ggccccaggtggtccagtcc

SEQ ID NO: 3360 - DNA, 20 bp, Artificial sequence
  Synthetic oligonucleotide
attctggccccaggtggtcc

SEQ ID NO: 3361 - DNA, 20 bp, Artificial sequence
  Synthetic oligonucleotide
tggtctcccagcaaaatgat

SEQ ID NO: 3362 - DNA, 20 bp, Artificial sequence
  Synthetic oligonucleotide
cctcctggtctcccagcaaa

SEQ ID NO: 3363 - DNA, 20 bp, Artificial sequence
  Synthetic oligonucleotide
cctgacctcctggtctccca

SEQ ID NO: 3364 - DNA, 20 bp, Artificial sequence
  Synthetic oligonucleotide
tccttcctgacctcctggtc

SEQ ID NO: 3365 - DNA, 20 bp, Artificial sequence
  Synthetic oligonucleotide
caccctccttcctgacctcc

SEQ ID NO: 3366 - DNA, 20 bp, Artificial sequence
  Synthetic oligonucleotide
ttccaaagcctgaggtaagg

SEQ ID NO: 3367 - DNA, 20 bp, Artificial sequence
  Synthetic oligonucleotide
tcttcttccaaagcctgagg

SEQ ID NO: 3368 - DNA, 20 bp, Artificial sequence
  Synthetic oligonucleotide
cagcctcttcttccaaagcc

SEQ ID NO: 3369 - DNA, 20 bp, Artificial sequence
  Synthetic oligonucleotide
ctggcccagggctgagcctg

SEQ ID NO: 3370 - DNA, 20 bp, Artificial sequence
  Synthetic oligonucleotide
tccctgaaggcagggactgg

SEQ ID NO: 3371 - DNA, 20 bp, Artificial sequence
  Synthetic oligonucleotide
ggtgctccctgaaggcaggg

SEQ ID NO: 3372 - DNA, 20 bp, Artificial sequence
  Synthetic oligonucleotide
cccttggtgctccctgaagg

SEQ ID NO: 3373 - DNA, 20 bp, Artificial sequence
  Synthetic oligonucleotide
cacactgtgttgtcactgtc

SEQ ID NO: 3374 - DNA, 20 bp, Artificial sequence
  Synthetic oligonucleotide
ctcagcacactgtgttgtca

SEQ ID NO: 3375 - DNA, 20 bp, Artificial sequence
  Synthetic oligonucleotide
acagtctcagcacactgtgt

SEQ ID NO: 3376 - DNA, 20 bp, Artificial sequence
  Synthetic oligonucleotide
agccctggactcaccattgt

SEQ ID NO: 3377 - DNA, 20 bp, Artificial sequence
  Synthetic oligonucleotide
ctctcagccctggactcacc

SEQ ID NO: 3378 - DNA, 20 bp, Artificial sequence
  Synthetic oligonucleotide
gcctctgccaggaagttctc

SEQ ID NO: 3379 - DNA, 20 bp, Artificial sequence
  Synthetic oligonucleotide
ggcctgcctctgccaggaag

SEQ ID NO: 3380 - DNA, 20 bp, Artificial sequence
  Synthetic oligonucleotide
tgcagggcctgcctctgcca

SEQ ID NO: 3381 - DNA, 20 bp, Artificial sequence
  Synthetic oligonucleotide
gaatgcctgttttccacctc

SEQ ID NO: 3382 - DNA, 20 bp, Artificial sequence
  Synthetic oligonucleotide
ctctggaatgcctgttttcc

SEQ ID NO: 3383 - DNA, 20 bp, Artificial sequence
  Synthetic oligonucleotide
aggcaaagggaaggctgagc

SEQ ID NO: 3384 - DNA, 20 bp, Artificial sequence
  Synthetic oligonucleotide
cccccaggcaaagggaaggc

SEQ ID NO: 3385 - DNA, 20 bp, Artificial sequence
  Synthetic oligonucleotide
gccttctgccccactgctag

SEQ ID NO: 3386 - DNA, 20 bp, Artificial sequence
  Synthetic oligonucleotide
gatgggccttctgccccact

SEQ ID NO: 3387 - DNA, 20 bp, Artificial sequence
  Synthetic oligonucleotide
gttctgatgggccttctgcc

SEQ ID NO: 3388 - DNA, 20 bp, Artificial sequence
  Synthetic oligonucleotide
accaggttctgatgggcctt

SEQ ID NO: 3389 - DNA, 20 bp, Artificial sequence
  Synthetic oligonucleotide
tctctaccaggttctgatgg

SEQ ID NO: 3390 - DNA, 20 bp, Artificial sequence
  Synthetic oligonucleotide
ggccctggacactggccaag

SEQ ID NO: 3391 - DNA, 20 bp, Artificial sequence
  Synthetic oligonucleotide
ctagaggccctggacactgg

SEQ ID NO: 3392 - DNA, 20 bp, Artificial sequence
  Synthetic oligonucleotide
gtcagcctagaggccctgga

SEQ ID NO: 3393 - DNA, 20 bp, Artificial sequence
  Synthetic oligonucleotide
ccagggtctgtcatacccta

SEQ ID NO: 3394 - DNA, 20 bp, Artificial sequence
  Synthetic oligonucleotide
agaggccagggtctgtcata

SEQ ID NO: 3395 - DNA, 20 bp, Artificial sequence
  Synthetic oligonucleotide
tctggaagggagaggccagg

SEQ ID NO: 3396 - DNA, 20 bp, Artificial sequence
  Synthetic oligonucleotide
accaacagtggtgatgggct

SEQ ID NO: 3397 - DNA, 20 bp, Artificial sequence
  Synthetic oligonucleotide
ggcttaccaacagtggtgat

SEQ ID NO: 3398 - DNA, 20 bp, Artificial sequence
  Synthetic oligonucleotide
gttcaggacagcccttggtc

SEQ ID NO: 3399 - DNA, 20 bp, Artificial sequence
  Synthetic oligonucleotide
cctgtgttcaggacagccct

SEQ ID NO: 3400 - DNA, 20 bp, Artificial sequence
  Synthetic oligonucleotide
ggcaccctgtgttcaggaca

SEQ ID NO: 3401 - DNA, 20 bp, Artificial sequence
  Synthetic oligonucleotide
aatcccgtctctactgctga

SEQ ID NO: 3402 - DNA, 20 bp, Artificial sequence
  Synthetic oligonucleotide
tcagagccaggtggcctgca

SEQ ID NO: 3403 - DNA, 20 bp, Artificial sequence
  Synthetic oligonucleotide
ggccatcagagccaggtggc

SEQ ID NO: 3404 - DNA, 20 bp, Artificial sequence
  Synthetic oligonucleotide
ggcatggccatcagagccag

SEQ ID NO: 3405 - DNA, 20 bp, Artificial sequence
  Synthetic oligonucleotide
ctaagggcatggccatcaga

SEQ ID NO: 3406 - DNA, 20 bp, Artificial sequence
  Synthetic oligonucleotide
catggctaagggcatggcca

SEQ ID NO: 3407 - DNA, 20 bp, Artificial sequence
  Synthetic oligonucleotide
gtcctcatggctaagggcat

SEQ ID NO: 3408 - DNA, 20 bp, Artificial sequence
  Synthetic oligonucleotide
tcaaagtcctcatggctaag

SEQ ID NO: 3409 - DNA, 20 bp, Artificial sequence
  Synthetic oligonucleotide
acacttcaaagtcctcatgg

SEQ ID NO: 3410 - DNA, 20 bp, Artificial sequence
  Synthetic oligonucleotide
acccaacacttcaaagtcct

SEQ ID NO: 3411 - DNA, 20 bp, Artificial sequence
  Synthetic oligonucleotide
tcagcacccaacacttcaaa

SEQ ID NO: 3412 - DNA, 20 bp, Artificial sequence
  Synthetic oligonucleotide
atcacagagcttggttcatc

SEQ ID NO: 3413 - DNA, 20 bp, Artificial sequence
  Synthetic oligonucleotide
gactgcagattttctttcct

SEQ ID NO: 3414 - DNA, 20 bp, Artificial sequence
  Synthetic oligonucleotide
gtcttccctgatagactagt

SEQ ID NO: 3415 - DNA, 20 bp, Artificial sequence
  Synthetic oligonucleotide
tcctcatcacattcccccac

SEQ ID NO: 3416 - DNA, 20 bp, Artificial sequence
  Synthetic oligonucleotide
agagttacctcctccctggg

SEQ ID NO: 3417 - DNA, 20 bp, Artificial sequence
  Synthetic oligonucleotide
gtgcaagagttacctcctcc

SEQ ID NO: 3418 - DNA, 20 bp, Artificial sequence
  Synthetic oligonucleotide
tagcagtgcaagagttacct

SEQ ID NO: 3419 - DNA, 20 bp, Artificial sequence
  Synthetic oligonucleotide
tcagttagcagtgcaagagt

SEQ ID NO: 3420 - DNA, 20 bp, Artificial sequence
  Synthetic oligonucleotide
tcctatcagttagcagtgca

SEQ ID NO: 3421 - DNA, 20 bp, Artificial sequence
  Synthetic oligonucleotide
ataattcctatcagttagca

SEQ ID NO: 3422 - DNA, 20 bp, Artificial sequence
  Synthetic oligonucleotide
gctagataattcctatcagt

SEQ ID NO: 3423 - DNA, 20 bp, Artificial sequence
  Synthetic oligonucleotide
attttgctagataattccta

SEQ ID NO: 3424 - DNA, 20 bp, Artificial sequence
  Synthetic oligonucleotide
cctctattttgctagataat

SEQ ID NO: 3425 - DNA, 20 bp, Artificial sequence
  Synthetic oligonucleotide
ttctgataaaaattctcttc

SEQ ID NO: 3426 - DNA, 20 bp, Artificial sequence
  Synthetic oligonucleotide
attgtttctgataaaaattc

SEQ ID NO: 3427 - DNA, 20 bp, Artificial sequence
  Synthetic oligonucleotide
aggctattgtttctgataaa

SEQ ID NO: 3428 - DNA, 20 bp, Artificial sequence
  Synthetic oligonucleotide
ctatgctgcagtcatattaa

SEQ ID NO: 3429 - DNA, 20 bp, Artificial sequence
  Synthetic oligonucleotide
caggtctatgctgcagtcat

SEQ ID NO: 3430 - DNA, 20 bp, Artificial sequence
  Synthetic oligonucleotide
tctgacaggtctatgctgca

SEQ ID NO: 3431 - DNA, 20 bp, Artificial sequence
  Synthetic oligonucleotide
actcttctgacaggtctatg

SEQ ID NO: 3432 - DNA, 20 bp, Artificial sequence
  Synthetic oligonucleotide
tttccactcttctgacaggt

SEQ ID NO: 3433 - DNA, 20 bp, Artificial sequence
  Synthetic oligonucleotide
attctttagaatcctctaaa

SEQ ID NO: 3434 - DNA, 20 bp, Artificial sequence
  Synthetic oligonucleotide
aggtaattctttagaatcct

SEQ ID NO: 3435 - DNA, 20 bp, Artificial sequence
  Synthetic oligonucleotide
aagggcccatgtgctcctgg

SEQ ID NO: 3436 - DNA, 20 bp, Artificial sequence
  Synthetic oligonucleotide
ctgccaagggcccatgtgct

SEQ ID NO: 3437 - DNA, 20 bp, Artificial sequence
  Synthetic oligonucleotide
gtccactgccaagggcccat

SEQ ID NO: 3438 - DNA, 20 bp, Artificial sequence
  Synthetic oligonucleotide
ctcaagtccactgccaaggg

SEQ ID NO: 3439 - DNA, 20 bp, Artificial sequence
  Synthetic oligonucleotide
ggcccctcaagtccactgcc

SEQ ID NO: 3440 - DNA, 20 bp, Artificial sequence
  Synthetic oligonucleotide
gctttggcccctcaagtcca

SEQ ID NO: 3441 - DNA, 20 bp, Artificial sequence
  Synthetic oligonucleotide
taaaagtacaaggcaggaca

SEQ ID NO: 3442 - DNA, 20 bp, Artificial sequence
  Synthetic oligonucleotide
tccctgttgctttgtctcta

SEQ ID NO: 3443 - DNA, 20 bp, Artificial sequence
  Synthetic oligonucleotide
ctgcctccctgttgctttgt

SEQ ID NO: 3444 - DNA, 20 bp, Artificial sequence
  Synthetic oligonucleotide
tcctgctgcctccctgttgc

SEQ ID NO: 3445 - DNA, 20 bp, Artificial sequence
  Synthetic oligonucleotide
aatgttcctgctgcctccct

SEQ ID NO: 3446 - DNA, 20 bp, Artificial sequence
  Synthetic oligonucleotide
atggaaatgttcctgctgcc

SEQ ID NO: 3447 - DNA, 20 bp, Artificial sequence
  Synthetic oligonucleotide
tgtgcatggaaatgttcctg

SEQ ID NO: 3448 - DNA, 20 bp, Artificial sequence
  Synthetic oligonucleotide
acacctgtgcatggaaatgt

SEQ ID NO: 3449 - DNA, 20 bp, Artificial sequence
  Synthetic oligonucleotide
cagccacacctgtgcatgga

SEQ ID NO: 3450 - DNA, 20 bp, Artificial sequence
  Synthetic oligonucleotide
ctccccagccacacctgtgc

SEQ ID NO: 3451 - DNA, 20 bp, Artificial sequence
  Synthetic oligonucleotide
agcccctccccagccacacc

SEQ ID NO: 3452 - DNA, 20 bp, Artificial sequence
  Synthetic oligonucleotide
cttcacattgcccacaggac

SEQ ID NO: 3453 - DNA, 20 bp, Artificial sequence
  Synthetic oligonucleotide
aattccttcacattgcccac

SEQ ID NO: 3454 - DNA, 20 bp, Artificial sequence
  Synthetic oligonucleotide
gagcaaattccttcacattg

SEQ ID NO: 3455 - DNA, 20 bp, Artificial sequence
  Synthetic oligonucleotide
gtgaagagcaaattccttca

SEQ ID NO: 3456 - DNA, 20 bp, Artificial sequence
  Synthetic oligonucleotide
tcaaggtgaagagcaaattc

SEQ ID NO: 3457 - DNA, 20 bp, Artificial sequence
  Synthetic oligonucleotide
cattctcaaggtgaagagca

SEQ ID NO: 3458 - DNA, 20 bp, Artificial sequence
  Synthetic oligonucleotide
ctctccattctcaaggtgaa

SEQ ID NO: 3459 - DNA, 20 bp, Artificial sequence
  Synthetic oligonucleotide
cctcccaaacactctctggt

SEQ ID NO: 3460 - DNA, 20 bp, Artificial sequence
  Synthetic oligonucleotide
cttcccctcccaaacactct

SEQ ID NO: 3461 - DNA, 20 bp, Artificial sequence
  Synthetic oligonucleotide
aaaaatatacatgctctttt

SEQ ID NO: 3462 - DNA, 20 bp, Artificial sequence
  Synthetic oligonucleotide
caaaaatatacatgctcttt

SEQ ID NO: 3463 - DNA, 20 bp, Artificial sequence
  Synthetic oligonucleotide
tcaaaaatatacatgctctt

SEQ ID NO: 3464 - DNA, 20 bp, Artificial sequence
  Synthetic oligonucleotide
ctcaaaaatatacatgctct

SEQ ID NO: 3465 - DNA, 20 bp, Artificial sequence
  Synthetic oligonucleotide
tactcaaaaatatacatgct

SEQ ID NO: 3466 - DNA, 20 bp, Artificial sequence
  Synthetic oligonucleotide
ctactcaaaaatatacatgc

SEQ ID NO: 3467 - DNA, 20 bp, Artificial sequence
  Synthetic oligonucleotide
tctactcaaaaatatacatg

SEQ ID NO: 3468 - DNA, 20 bp, Artificial sequence
  Synthetic oligonucleotide
ccagcactaatttttacaac

SEQ ID NO: 3469 - DNA, 20 bp, Artificial sequence
  Synthetic oligonucleotide
tccagcactaatttttacaa

SEQ ID NO: 3470 - DNA, 20 bp, Artificial sequence
  Synthetic oligonucleotide
atccagcactaatttttaca

SEQ ID NO: 3471 - DNA, 20 bp, Artificial sequence
  Synthetic oligonucleotide
gtggctctctagatagggtg

SEQ ID NO: 3472 - DNA, 20 bp, Artificial sequence
  Synthetic oligonucleotide
ctcagccttggagccagctc

SEQ ID NO: 3473 - DNA, 20 bp, Artificial sequence
  Synthetic oligonucleotide
actcagccttggagccagct

SEQ ID NO: 3474 - DNA, 20 bp, Artificial sequence
  Synthetic oligonucleotide
cactcagccttggagccagc

SEQ ID NO: 3475 - DNA, 20 bp, Artificial sequence
  Synthetic oligonucleotide
ccactcagccttggagccag

SEQ ID NO: 3476 - DNA, 20 bp, Artificial sequence
  Synthetic oligonucleotide
tgccactcagccttggagcc

SEQ ID NO: 3477 - DNA, 20 bp, Artificial sequence
  Synthetic oligonucleotide
ttgccactcagccttggagc

SEQ ID NO: 3478 - DNA, 20 bp, Artificial sequence
  Synthetic oligonucleotide
ggagtttgtgtttcccattt

SEQ ID NO: 3479 - DNA, 20 bp, Artificial sequence
  Synthetic oligonucleotide
aaggagtttgtgtttcccat

SEQ ID NO: 3480 - DNA, 20 bp, Artificial sequence
  Synthetic oligonucleotide
aaaggagtttgtgtttccca

SEQ ID NO: 3481 - DNA, 20 bp, Artificial sequence
  Synthetic oligonucleotide
gaaaaggagtttgtgtttcc

SEQ ID NO: 3482 - DNA, 20 bp, Artificial sequence
  Synthetic oligonucleotide
agaaaaggagtttgtgtttc

SEQ ID NO: 3483 - DNA, 20 bp, Artificial sequence
  Synthetic oligonucleotide
aagaaaaggagtttgtgttt

SEQ ID NO: 3484 - DNA, 20 bp, Artificial sequence
  Synthetic oligonucleotide
taagaaaaggagtttgtgtt

SEQ ID NO: 3485 - DNA, 20 bp, Artificial sequence
  Synthetic oligonucleotide
attttcacaaggagaagctg

SEQ ID NO: 3486 - DNA, 20 bp, Artificial sequence
  Synthetic oligonucleotide
cattttcacaaggagaagct

SEQ ID NO: 3487 - DNA, 20 bp, Artificial sequence
  Synthetic oligonucleotide
ccattttcacaaggagaagc

SEQ ID NO: 3488 - DNA, 20 bp, Artificial sequence
  Synthetic oligonucleotide
gcaccattttcacaaggaga

SEQ ID NO: 3489 - DNA, 20 bp, Artificial sequence
  Synthetic oligonucleotide
tgcaccattttcacaaggag

SEQ ID NO: 3490 - DNA, 20 bp, Artificial sequence
  Synthetic oligonucleotide
gtgcaccattttcacaagga

SEQ ID NO: 3491 - DNA, 20 bp, Artificial sequence
  Synthetic oligonucleotide
agtgcaccattttcacaagg

SEQ ID NO: 3492 - DNA, 20 bp, Artificial sequence
  Synthetic oligonucleotide
catcacaatatatgggcaag

SEQ ID NO: 3493 - DNA, 20 bp, Artificial sequence
  Synthetic oligonucleotide
ccatcacaatatatgggcaa

SEQ ID NO: 3494 - DNA, 20 bp, Artificial sequence
  Synthetic oligonucleotide
cccatcacaatatatgggca

SEQ ID NO: 3495 - DNA, 20 bp, Artificial sequence
  Synthetic oligonucleotide
ccccatcacaatatatgggc

SEQ ID NO: 3496 - DNA, 20 bp, Artificial sequence
  Synthetic oligonucleotide
aggtaaggccaaggaagtga

SEQ ID NO: 3497 - DNA, 20 bp, Artificial sequence
  Synthetic oligonucleotide
gaggtaaggccaaggaagtg

SEQ ID NO: 3498 - DNA, 20 bp, Artificial sequence
  Synthetic oligonucleotide
agaggtaaggccaaggaagt

SEQ ID NO: 3499 - DNA, 20 bp, Artificial sequence
  Synthetic oligonucleotide
aagaggtaaggccaaggaag

SEQ ID NO: 3500 - DNA, 20 bp, Artificial sequence
  Synthetic oligonucleotide
cacctgggtttttgtgtatt

SEQ ID NO: 3501 - DNA, 20 bp, Artificial sequence
  Synthetic oligonucleotide
acacctgggtttttgtgtat

SEQ ID NO: 3502 - DNA, 20 bp, Artificial sequence
  Synthetic oligonucleotide
tacacctgggtttttgtgta

SEQ ID NO: 3503 - DNA, 20 bp, Artificial sequence
  Synthetic oligonucleotide
atacacctgggtttttgtgt

SEQ ID NO: 3504 - DNA, 20 bp, Artificial sequence
  Synthetic oligonucleotide
tctgagtgctgctaacttgg

SEQ ID NO: 3505 - DNA, 20 bp, Artificial sequence
  Synthetic oligonucleotide
atctgagtgctgctaacttg

SEQ ID NO: 3506 - DNA, 20 bp, Artificial sequence
  Synthetic oligonucleotide
aatctgagtgctgctaactt

SEQ ID NO: 3507 - DNA, 20 bp, Artificial sequence
  Synthetic oligonucleotide
aaatctgagtgctgctaact

SEQ ID NO: 3508 - DNA, 20 bp, Artificial sequence
  Synthetic oligonucleotide
tgaaatctgagtgctgctaa

SEQ ID NO: 3509 - DNA, 20 bp, Artificial sequence
  Synthetic oligonucleotide
ttgaaatctgagtgctgcta

SEQ ID NO: 3510 - DNA, 20 bp, Artificial sequence
  Synthetic oligonucleotide
gttgaaatctgagtgctgct

SEQ ID NO: 3511 - DNA, 20 bp, Artificial sequence
  Synthetic oligonucleotide
gcactaaattaggaagctgg

SEQ ID NO: 3512 - DNA, 20 bp, Artificial sequence
  Synthetic oligonucleotide
agcactaaattaggaagctg

SEQ ID NO: 3513 - DNA, 20 bp, Artificial sequence
  Synthetic oligonucleotide
ctgggacatctggcccaaag

SEQ ID NO: 3514 - DNA, 20 bp, Artificial sequence
  Synthetic oligonucleotide
actgggacatctggcccaaa

SEQ ID NO: 3515 - DNA, 20 bp, Artificial sequence
  Synthetic oligonucleotide
cactgggacatctggcccaa

SEQ ID NO: 3516 - DNA, 20 bp, Artificial sequence
  Synthetic oligonucleotide
ccactgggacatctggccca

SEQ ID NO: 3517 - DNA, 20 bp, Artificial sequence
  Synthetic oligonucleotide
gcccactgggacatctggcc

SEQ ID NO: 3518 - DNA, 20 bp, Artificial sequence
  Synthetic oligonucleotide
ggcccactgggacatctggc

SEQ ID NO: 3519 - DNA, 20 bp, Artificial sequence
  Synthetic oligonucleotide
ccttaaagcagggcccactg

SEQ ID NO: 3520 - DNA, 20 bp, Artificial sequence
  Synthetic oligonucleotide
tccttaaagcagggcccact

SEQ ID NO: 3521 - DNA, 20 bp, Artificial sequence
  Synthetic oligonucleotide
atccttaaagcagggcccac

SEQ ID NO: 3522 - DNA, 20 bp, Artificial sequence
  Synthetic oligonucleotide
tatccttaaagcagggccca

SEQ ID NO: 3523 - DNA, 20 bp, Artificial sequence
  Synthetic oligonucleotide
cactggtgcctaagagccct

SEQ ID NO: 3524 - DNA, 20 bp, Artificial sequence
  Synthetic oligonucleotide
ccactggtgcctaagagccc

SEQ ID NO: 3525 - DNA, 20 bp, Artificial sequence
  Synthetic oligonucleotide
tccactggtgcctaagagcc

SEQ ID NO: 3526 - DNA, 20 bp, Artificial sequence
  Synthetic oligonucleotide
ctccactggtgcctaagagc

SEQ ID NO: 3527 - DNA, 20 bp, Artificial sequence
  Synthetic oligonucleotide
gaggctgagttctgctcctg

SEQ ID NO: 3528 - DNA, 20 bp, Artificial sequence
  Synthetic oligonucleotide
agaggctgagttctgctcct

SEQ ID NO: 3529 - DNA, 20 bp, Artificial sequence
  Synthetic oligonucleotide
tagaggctgagttctgctcc

SEQ ID NO: 3530 - DNA, 20 bp, Artificial sequence
  Synthetic oligonucleotide
ctagaggctgagttctgctc

SEQ ID NO: 3531 - DNA, 20 bp, Artificial sequence
  Synthetic oligonucleotide
tgctagaggctgagttctgc

SEQ ID NO: 3532 - DNA, 20 bp, Artificial sequence
  Synthetic oligonucleotide
ctgctagaggctgagttctg

SEQ ID NO: 3533 - DNA, 20 bp, Artificial sequence
  Synthetic oligonucleotide
tctgctagaggctgagttct

SEQ ID NO: 3534 - DNA, 20 bp, Artificial sequence
  Synthetic oligonucleotide
atctgctagaggctgagttc

SEQ ID NO: 3535 - DNA, 20 bp, Artificial sequence
  Synthetic oligonucleotide
cttgggcatctgctagaggc

SEQ ID NO: 3536 - DNA, 20 bp, Artificial sequence
  Synthetic oligonucleotide
tcttgggcatctgctagagg

SEQ ID NO: 3537 - DNA, 20 bp, Artificial sequence
  Synthetic oligonucleotide
ttcttgggcatctgctagag

SEQ ID NO: 3538 - DNA, 20 bp, Artificial sequence
  Synthetic oligonucleotide
cttcttgggcatctgctaga

SEQ ID NO: 3539 - DNA, 20 bp, Artificial sequence
  Synthetic oligonucleotide
tgcttcttgggcatctgcta

SEQ ID NO: 3540 - DNA, 20 bp, Artificial sequence
  Synthetic oligonucleotide
ctgcttcttgggcatctgct

SEQ ID NO: 3541 - DNA, 20 bp, Artificial sequence
  Synthetic oligonucleotide
tctgcttcttgggcatctgc

SEQ ID NO: 3542 - DNA, 20 bp, Artificial sequence
  Synthetic oligonucleotide
ctctgcttcttgggcatctg

SEQ ID NO: 3543 - DNA, 20 bp, Artificial sequence
  Synthetic oligonucleotide
tcctctgcttcttgggcatc

SEQ ID NO: 3544 - DNA, 20 bp, Artificial sequence
  Synthetic oligonucleotide
ctcctctgcttcttgggcat

SEQ ID NO: 3545 - DNA, 20 bp, Artificial sequence
  Synthetic oligonucleotide
tctcctctgcttcttgggca

SEQ ID NO: 3546 - DNA, 20 bp, Artificial sequence
  Synthetic oligonucleotide
ctttctaagtaccctttaca

SEQ ID NO: 3547 - DNA, 20 bp, Artificial sequence
  Synthetic oligonucleotide
gctttctaagtaccctttac

SEQ ID NO: 3548 - DNA, 20 bp, Artificial sequence
  Synthetic oligonucleotide
tgctttctaagtacccttta

SEQ ID NO: 3549 - DNA, 20 bp, Artificial sequence
  Synthetic oligonucleotide
gtgctttctaagtacccttt

SEQ ID NO: 3550 - DNA, 20 bp, Artificial sequence
  Synthetic oligonucleotide
cagtgctttctaagtaccct

SEQ ID NO: 3551 - DNA, 20 bp, Artificial sequence
  Synthetic oligonucleotide
agggaaaggtcttctccagc

SEQ ID NO: 3552 - DNA, 20 bp, Artificial sequence
  Synthetic oligonucleotide
gagggaaaggtcttctccag

SEQ ID NO: 3553 - DNA, 20 bp, Artificial sequence
  Synthetic oligonucleotide
ggagggaaaggtcttctcca

SEQ ID NO: 3554 - DNA, 20 bp, Artificial sequence
  Synthetic oligonucleotide
aggagggaaaggtcttctcc

SEQ ID NO: 3555 - DNA, 20 bp, Artificial sequence
  Synthetic oligonucleotide
gtctcattcatctgggccct

SEQ ID NO: 3556 - DNA, 20 bp, Artificial sequence
  Synthetic oligonucleotide
tgtctcattcatctgggccc

SEQ ID NO: 3557 - DNA, 20 bp, Artificial sequence
  Synthetic oligonucleotide
atgtctcattcatctgggcc

SEQ ID NO: 3558 - DNA, 20 bp, Artificial sequence
  Synthetic oligonucleotide
cccctgtactcagccctttc

SEQ ID NO: 3559 - DNA, 20 bp, Artificial sequence
  Synthetic oligonucleotide
acccctgtactcagcccttt

SEQ ID NO: 3560 - DNA, 20 bp, Artificial sequence
  Synthetic oligonucleotide
cacccctgtactcagccctt

SEQ ID NO: 3561 - DNA, 20 bp, Artificial sequence
  Synthetic oligonucleotide
tcacccctgtactcagccct

SEQ ID NO: 3562 - DNA, 20 bp, Artificial sequence
  Synthetic oligonucleotide
tctcacccctgtactcagcc

SEQ ID NO: 3563 - DNA, 20 bp, Artificial sequence
  Synthetic oligonucleotide
atctcacccctgtactcagc

SEQ ID NO: 3564 - DNA, 20 bp, Artificial sequence
  Synthetic oligonucleotide
catctcacccctgtactcag

SEQ ID NO: 3565 - DNA, 20 bp, Artificial sequence
  Synthetic oligonucleotide
ccatctcacccctgtactca

SEQ ID NO: 3566 - DNA, 20 bp, Artificial sequence
  Synthetic oligonucleotide
aagtcttccttctcctccac

SEQ ID NO: 3567 - DNA, 20 bp, Artificial sequence
  Synthetic oligonucleotide
aaagtcttccttctcctcca

SEQ ID NO: 3568 - DNA, 20 bp, Artificial sequence
  Synthetic oligonucleotide
gaaagtcttccttctcctcc

SEQ ID NO: 3569 - DNA, 20 bp, Artificial sequence
  Synthetic oligonucleotide
ggaaagtcttccttctcctc

SEQ ID NO: 3570 - DNA, 20 bp, Artificial sequence
  Synthetic oligonucleotide
caggtagagttctattgctt

SEQ ID NO: 3571 - DNA, 20 bp, Artificial sequence
  Synthetic oligonucleotide
ccaggtagagttctattgct

SEQ ID NO: 3572 - DNA, 20 bp, Artificial sequence
  Synthetic oligonucleotide
ggctactggcattgctcctc

SEQ ID NO: 3573 - DNA, 20 bp, Artificial sequence
  Synthetic oligonucleotide
tggctactggcattgctcct

SEQ ID NO: 3574 - DNA, 20 bp, Artificial sequence
  Synthetic oligonucleotide
gtggctactggcattgctcc

SEQ ID NO: 3575 - DNA, 20 bp, Artificial sequence
  Synthetic oligonucleotide
ggtggctactggcattgctc

SEQ ID NO: 3576 - DNA, 20 bp, Artificial sequence
  Synthetic oligonucleotide
acatgcctgagggcagcagt

SEQ ID NO: 3577 - DNA, 20 bp, Artificial sequence
  Synthetic oligonucleotide
cacatgcctgagggcagcag

SEQ ID NO: 3578 - DNA, 20 bp, Artificial sequence
  Synthetic oligonucleotide
tcacatgcctgagggcagca

SEQ ID NO: 3579 - DNA, 20 bp, Artificial sequence
  Synthetic oligonucleotide
ctcacatgcctgagggcagc

SEQ ID NO: 3580 - DNA, 20 bp, Artificial sequence
  Synthetic oligonucleotide
aatatctgatatcaaagtga

SEQ ID NO: 3581 - DNA, 20 bp, Artificial sequence
  Synthetic oligonucleotide
caatatctgatatcaaagtg

SEQ ID NO: 3582 - DNA, 20 bp, Artificial sequence
  Synthetic oligonucleotide
ccaatatctgatatcaaagt

SEQ ID NO: 3583 - DNA, 20 bp, Artificial sequence
  Synthetic oligonucleotide
cccaatatctgatatcaaag

SEQ ID NO: 3584 - DNA, 20 bp, Artificial sequence
  Synthetic oligonucleotide
tgcccaatatctgatatcaa

SEQ ID NO: 3585 - DNA, 20 bp, Artificial sequence
  Synthetic oligonucleotide
ttgcccaatatctgatatca

SEQ ID NO: 3586 - DNA, 20 bp, Artificial sequence
  Synthetic oligonucleotide
ttgcttgaggtcagggtgtg

SEQ ID NO: 3587 - DNA, 20 bp, Artificial sequence
  Synthetic oligonucleotide
cttgcttgaggtcagggtgt

SEQ ID NO: 3588 - DNA, 20 bp, Artificial sequence
  Synthetic oligonucleotide
acttgcttgaggtcagggtg

SEQ ID NO: 3589 - DNA, 20 bp, Artificial sequence
  Synthetic oligonucleotide
cacttgcttgaggtcagggt

SEQ ID NO: 3590 - DNA, 20 bp, Artificial sequence
  Synthetic oligonucleotide
atcacttgcttgaggtcagg

SEQ ID NO: 3591 - DNA, 20 bp, Artificial sequence
  Synthetic oligonucleotide
aatcacttgcttgaggtcag

SEQ ID NO: 3592 - DNA, 20 bp, Artificial sequence
  Synthetic oligonucleotide
aaatcacttgcttgaggtca

SEQ ID NO: 3593 - DNA, 20 bp, Artificial sequence
  Synthetic oligonucleotide
aaaatcacttgcttgaggtc

SEQ ID NO: 3594 - DNA, 20 bp, Artificial sequence
  Synthetic oligonucleotide
ggtacaagtttctccaccta

SEQ ID NO: 3595 - DNA, 20 bp, Artificial sequence
  Synthetic oligonucleotide
aggtacaagtttctccacct

SEQ ID NO: 3596 - DNA, 20 bp, Artificial sequence
  Synthetic oligonucleotide
taggtacaagtttctccacc

SEQ ID NO: 3597 - DNA, 20 bp, Artificial sequence
  Synthetic oligonucleotide
ctaggtacaagtttctccac

SEQ ID NO: 3598 - DNA, 20 bp, Artificial sequence
  Synthetic oligonucleotide
atagctgagcaaatccataa

SEQ ID NO: 3599 - DNA, 20 bp, Artificial sequence
  Synthetic oligonucleotide
catagctgagcaaatccata

SEQ ID NO: 3600 - DNA, 20 bp, Artificial sequence
  Synthetic oligonucleotide
gcatagctgagcaaatccat

SEQ ID NO: 3601 - DNA, 20 bp, Artificial sequence
  Synthetic oligonucleotide
tgcatagctgagcaaatcca

SEQ ID NO: 3602 - DNA, 20 bp, Artificial sequence
  Synthetic oligonucleotide
actgcatagctgagcaaatc

SEQ ID NO: 3603 - DNA, 20 bp, Artificial sequence
  Synthetic oligonucleotide
tactgcatagctgagcaaat

SEQ ID NO: 3604 - DNA, 20 bp, Artificial sequence
  Synthetic oligonucleotide
ttactgcatagctgagcaaa

SEQ ID NO: 3605 - DNA, 20 bp, Artificial sequence
  Synthetic oligonucleotide
tttactgcatagctgagcaa

SEQ ID NO: 3606 - DNA, 20 bp, Artificial sequence
  Synthetic oligonucleotide
ggtttactgcatagctgagc

SEQ ID NO: 3607 - DNA, 20 bp, Artificial sequence
  Synthetic oligonucleotide
aggtttactgcatagctgag

SEQ ID NO: 3608 - DNA, 20 bp, Artificial sequence
  Synthetic oligonucleotide
gaggtttactgcatagctga

SEQ ID NO: 3609 - DNA, 20 bp, Artificial sequence
  Synthetic oligonucleotide
agaggtttactgcatagctg

SEQ ID NO: 3610 - DNA, 20 bp, Artificial sequence
  Synthetic oligonucleotide
atagaggtttactgcatagc

SEQ ID NO: 3611 - DNA, 20 bp, Artificial sequence
  Synthetic oligonucleotide
catagaggtttactgcatag

SEQ ID NO: 3612 - DNA, 20 bp, Artificial sequence
  Synthetic oligonucleotide
actctctctgcacactccca

SEQ ID NO: 3613 - DNA, 20 bp, Artificial sequence
  Synthetic oligonucleotide
cactctctctgcacactccc

SEQ ID NO: 3614 - DNA, 20 bp, Artificial sequence
  Synthetic oligonucleotide
gcactctctctgcacactcc

SEQ ID NO: 3615 - DNA, 20 bp, Artificial sequence
  Synthetic oligonucleotide
tgcactctctctgcacactc

SEQ ID NO: 3616 - DNA, 20 bp, Artificial sequence
  Synthetic oligonucleotide
tgctgattacaagctgattc

SEQ ID NO: 3617 - DNA, 20 bp, Artificial sequence
  Synthetic oligonucleotide
ctgctgattacaagctgatt

SEQ ID NO: 3618 - DNA, 20 bp, Artificial sequence
  Synthetic oligonucleotide
actgctgattacaagctgat

SEQ ID NO: 3619 - DNA, 20 bp, Artificial sequence
  Synthetic oligonucleotide
aactgctgattacaagctga

SEQ ID NO: 3620 - DNA, 20 bp, Artificial sequence
  Synthetic oligonucleotide
tggtgataaggcagcagtct

SEQ ID NO: 3621 - DNA, 20 bp, Artificial sequence
  Synthetic oligonucleotide
atggtgataaggcagcagtc

SEQ ID NO: 3622 - DNA, 20 bp, Artificial sequence
  Synthetic oligonucleotide
gatggtgataaggcagcagt

SEQ ID NO: 3623 - DNA, 20 bp, Artificial sequence
  Synthetic oligonucleotide
agatggtgataaggcagcag

SEQ ID NO: 3624 - DNA, 20 bp, Artificial sequence
  Synthetic oligonucleotide
agagatggtgataaggcagc

SEQ ID NO: 3625 - DNA, 20 bp, Artificial sequence
  Synthetic oligonucleotide
cagagatggtgataaggcag

SEQ ID NO: 3626 - DNA, 20 bp, Artificial sequence
  Synthetic oligonucleotide
ccagagatggtgataaggca

SEQ ID NO: 3627 - DNA, 20 bp, Artificial sequence
  Synthetic oligonucleotide
cccagagatggtgataaggc

SEQ ID NO: 3628 - DNA, 20 bp, Artificial sequence
  Synthetic oligonucleotide
agacttgcccagcaacccat

SEQ ID NO: 3629 - DNA, 20 bp, Artificial sequence
  Synthetic oligonucleotide
cagacttgcccagcaaccca

SEQ ID NO: 3630 - DNA, 20 bp, Artificial sequence
  Synthetic oligonucleotide
ccagacttgcccagcaaccc

SEQ ID NO: 3631 - DNA, 20 bp, Artificial sequence
  Synthetic oligonucleotide
tccagacttgcccagcaacc

SEQ ID NO: 3632 - DNA, 20 bp, Artificial sequence
  Synthetic oligonucleotide
aaacctaggttcagactttg

SEQ ID NO: 3633 - DNA, 20 bp, Artificial sequence
  Synthetic oligonucleotide
caaacctaggttcagacttt

SEQ ID NO: 3634 - DNA, 20 bp, Artificial sequence
  Synthetic oligonucleotide
gtcaaacctaggttcagact

SEQ ID NO: 3635 - DNA, 20 bp, Artificial sequence
  Synthetic oligonucleotide
gagtcaaacctaggttcaga

SEQ ID NO: 3636 - DNA, 20 bp, Artificial sequence
  Synthetic oligonucleotide
agagtcaaacctaggttcag

SEQ ID NO: 3637 - DNA, 20 bp, Artificial sequence
  Synthetic oligonucleotide
aagagtcaaacctaggttca

SEQ ID NO: 3638 - DNA, 20 bp, Artificial sequence
  Synthetic oligonucleotide
gaagagtcaaacctaggttc

SEQ ID NO: 3639 - DNA, 20 bp, Artificial sequence
  Synthetic oligonucleotide
gagcatccccaatccctgct

SEQ ID NO: 3640 - DNA, 20 bp, Artificial sequence
  Synthetic oligonucleotide
tgagcatccccaatccctgc

SEQ ID NO: 3641 - DNA, 20 bp, Artificial sequence
  Synthetic oligonucleotide
ttgagcatccccaatccctg

SEQ ID NO: 3642 - DNA, 20 bp, Artificial sequence
  Synthetic oligonucleotide
tttgagcatccccaatccct

SEQ ID NO: 3643 - DNA, 20 bp, Artificial sequence
  Synthetic oligonucleotide
actttgagcatccccaatcc

SEQ ID NO: 3644 - DNA, 20 bp, Artificial sequence
  Synthetic oligonucleotide
tactttgagcatccccaatc

SEQ ID NO: 3645 - DNA, 20 bp, Artificial sequence
  Synthetic oligonucleotide
gtactttgagcatccccaat

SEQ ID NO: 3646 - DNA, 20 bp, Artificial sequence
  Synthetic oligonucleotide
tgtactttgagcatccccaa

SEQ ID NO: 3647 - DNA, 20 bp, Artificial sequence
  Synthetic oligonucleotide
agtgtactttgagcatcccc

SEQ ID NO: 3648 - DNA, 20 bp, Artificial sequence
  Synthetic oligonucleotide
aagtgtactttgagcatccc

SEQ ID NO: 3649 - DNA, 20 bp, Artificial sequence
  Synthetic oligonucleotide
caagtgtactttgagcatcc

SEQ ID NO: 3650 - DNA, 20 bp, Artificial sequence
  Synthetic oligonucleotide
ccaagtgtactttgagcatc

SEQ ID NO: 3651 - DNA, 20 bp, Artificial sequence
  Synthetic oligonucleotide
ctccaagtgtactttgagca

SEQ ID NO: 3652 - DNA, 20 bp, Artificial sequence
  Synthetic oligonucleotide
cagaggttcaacatccaatt

SEQ ID NO: 3653 - DNA, 20 bp, Artificial sequence
  Synthetic oligonucleotide
acagaggttcaacatccaat

SEQ ID NO: 3654 - DNA, 20 bp, Artificial sequence
  Synthetic oligonucleotide
gacagaggttcaacatccaa

SEQ ID NO: 3655 - DNA, 20 bp, Artificial sequence
  Synthetic oligonucleotide
ggacagaggttcaacatcca

SEQ ID NO: 3656 - DNA, 20 bp, Artificial sequence
  Synthetic oligonucleotide
caaggacagaggttcaacat

SEQ ID NO: 3657 - DNA, 20 bp, Artificial sequence
  Synthetic oligonucleotide
ccaaggacagaggttcaaca

SEQ ID NO: 3658 - DNA, 20 bp, Artificial sequence
  Synthetic oligonucleotide
gccaaggacagaggttcaac

SEQ ID NO: 3659 - DNA, 20 bp, Artificial sequence
  Synthetic oligonucleotide
ggccaaggacagaggttcaa

SEQ ID NO: 3660 - DNA, 20 bp, Artificial sequence
  Synthetic oligonucleotide
gaggccaaggacagaggttc

SEQ ID NO: 3661 - DNA, 20 bp, Artificial sequence
  Synthetic oligonucleotide
tgaggccaaggacagaggtt

SEQ ID NO: 3662 - DNA, 20 bp, Artificial sequence
  Synthetic oligonucleotide
gtgaggccaaggacagaggt

SEQ ID NO: 3663 - DNA, 20 bp, Artificial sequence
  Synthetic oligonucleotide
tgtgaggccaaggacagagg

SEQ ID NO: 3664 - DNA, 20 bp, Artificial sequence
  Synthetic oligonucleotide
tctgtgaggccaaggacaga

SEQ ID NO: 3665 - DNA, 20 bp, Artificial sequence
  Synthetic oligonucleotide
gtctgtgaggccaaggacag

SEQ ID NO: 3666 - DNA, 20 bp, Artificial sequence
  Synthetic oligonucleotide
tgtctgtgaggccaaggaca

SEQ ID NO: 3667 - DNA, 20 bp, Artificial sequence
  Synthetic oligonucleotide
ctgtctgtgaggccaaggac

SEQ ID NO: 3668 - DNA, 20 bp, Artificial sequence
  Synthetic oligonucleotide
agtctctcataattgccagt

SEQ ID NO: 3669 - DNA, 20 bp, Artificial sequence
  Synthetic oligonucleotide
aagtctctcataattgccag

SEQ ID NO: 3670 - DNA, 20 bp, Artificial sequence
  Synthetic oligonucleotide
gaagtctctcataattgcca

SEQ ID NO: 3671 - DNA, 20 bp, Artificial sequence
  Synthetic oligonucleotide
ggaagtctctcataattgcc

SEQ ID NO: 3672 - DNA, 20 bp, Artificial sequence
  Synthetic oligonucleotide
tgggaagtctctcataattg

SEQ ID NO: 3673 - DNA, 20 bp, Artificial sequence
  Synthetic oligonucleotide
ttgggaagtctctcataatt

SEQ ID NO: 3674 - DNA, 20 bp, Artificial sequence
  Synthetic oligonucleotide
cttgggaagtctctcataat

SEQ ID NO: 3675 - DNA, 20 bp, Artificial sequence
  Synthetic oligonucleotide
ccttgggaagtctctcataa

SEQ ID NO: 3676 - DNA, 20 bp, Artificial sequence
  Synthetic oligonucleotide
ggccttgggaagtctctcat

SEQ ID NO: 3677 - DNA, 20 bp, Artificial sequence
  Synthetic oligonucleotide
aggccttgggaagtctctca

SEQ ID NO: 3678 - DNA, 20 bp, Artificial sequence
  Synthetic oligonucleotide
taggccttgggaagtctctc

SEQ ID NO: 3679 - DNA, 20 bp, Artificial sequence
  Synthetic oligonucleotide
ctaggccttgggaagtctct

SEQ ID NO: 3680 - DNA, 20 bp, Artificial sequence
  Synthetic oligonucleotide
cattttggagaccacatgaa

SEQ ID NO: 3681 - DNA, 20 bp, Artificial sequence
  Synthetic oligonucleotide
tcattttggagaccacatga

SEQ ID NO: 3682 - DNA, 20 bp, Artificial sequence
  Synthetic oligonucleotide
gtcattttggagaccacatg

SEQ ID NO: 3683 - DNA, 20 bp, Artificial sequence
  Synthetic oligonucleotide
ggtcattttggagaccacat

SEQ ID NO: 3684 - DNA, 20 bp, Artificial sequence
  Synthetic oligonucleotide
aatgggaatggtatcgcact

SEQ ID NO: 3685 - DNA, 20 bp, Artificial sequence
  Synthetic oligonucleotide
caatgggaatggtatcgcac

SEQ ID NO: 3686 - DNA, 20 bp, Artificial sequence
  Synthetic oligonucleotide
acaatgggaatggtatcgca

SEQ ID NO: 3687 - DNA, 20 bp, Artificial sequence
  Synthetic oligonucleotide
cacaatgggaatggtatcgc

SEQ ID NO: 3688 - DNA, 20 bp, Artificial sequence
  Synthetic oligonucleotide
agctatagaatcagacagac

SEQ ID NO: 3689 - DNA, 20 bp, Artificial sequence
  Synthetic oligonucleotide
cagctatagaatcagacaga

SEQ ID NO: 3690 - DNA, 20 bp, Artificial sequence
  Synthetic oligonucleotide
tcagctatagaatcagacag

SEQ ID NO: 3691 - DNA, 20 bp, Artificial sequence
  Synthetic oligonucleotide
catcagctatagaatcagac

SEQ ID NO: 3692 - DNA, 20 bp, Artificial sequence
  Synthetic oligonucleotide
gcacttgatctgggacccaa

SEQ ID NO: 3693 - DNA, 20 bp, Artificial sequence
  Synthetic oligonucleotide
agcacttgatctgggaccca

SEQ ID NO: 3694 - DNA, 20 bp, Artificial sequence
  Synthetic oligonucleotide
gagcacttgatctgggaccc

SEQ ID NO: 3695 - DNA, 20 bp, Artificial sequence
  Synthetic oligonucleotide
agagcacttgatctgggacc

SEQ ID NO: 3696 - DNA, 20 bp, Artificial sequence
  Synthetic oligonucleotide
gtagagcacttgatctggga

SEQ ID NO: 3697 - DNA, 20 bp, Artificial sequence
  Synthetic oligonucleotide
ggtagagcacttgatctggg

SEQ ID NO: 3698 - DNA, 20 bp, Artificial sequence
  Synthetic oligonucleotide
gggtagagcacttgatctgg

SEQ ID NO: 3699 - DNA, 20 bp, Artificial sequence
  Synthetic oligonucleotide
aactatcacaccacctccca

SEQ ID NO: 3700 - DNA, 20 bp, Artificial sequence
  Synthetic oligonucleotide
gaactatcacaccacctccc

SEQ ID NO: 3701 - DNA, 20 bp, Artificial sequence
  Synthetic oligonucleotide
ggaactatcacaccacctcc

SEQ ID NO: 3702 - DNA, 20 bp, Artificial sequence
  Synthetic oligonucleotide
gggaactatcacaccacctc

SEQ ID NO: 3703 - DNA, 20 bp, Artificial sequence
  Synthetic oligonucleotide
atgggaactatcacaccacc

SEQ ID NO: 3704 - DNA, 20 bp, Artificial sequence
  Synthetic oligonucleotide
aatgggaactatcacaccac

SEQ ID NO: 3705 - DNA, 20 bp, Artificial sequence
  Synthetic oligonucleotide
aaatgggaactatcacacca

SEQ ID NO: 3706 - DNA, 20 bp, Artificial sequence
  Synthetic oligonucleotide
taaatgggaactatcacacc

SEQ ID NO: 3707 - DNA, 20 bp, Artificial sequence
  Synthetic oligonucleotide
tgaccttgggcaagttacct

SEQ ID NO: 3708 - DNA, 20 bp, Artificial sequence
  Synthetic oligonucleotide
gtgaccttgggcaagttacc

SEQ ID NO: 3709 - DNA, 20 bp, Artificial sequence
  Synthetic oligonucleotide
tgtgaccttgggcaagttac

SEQ ID NO: 3710 - DNA, 20 bp, Artificial sequence
  Synthetic oligonucleotide
gtgtgaccttgggcaagtta

SEQ ID NO: 3711 - DNA, 20 bp, Artificial sequence
  Synthetic oligonucleotide
ctgtgtgaccttgggcaagt

SEQ ID NO: 3712 - DNA, 20 bp, Artificial sequence
  Synthetic oligonucleotide
tctgtgtgaccttgggcaag

SEQ ID NO: 3713 - DNA, 20 bp, Artificial sequence
  Synthetic oligonucleotide
atctgtgtgaccttgggcaa

SEQ ID NO: 3714 - DNA, 20 bp, Artificial sequence
  Synthetic oligonucleotide
aatctgtgtgaccttgggca

SEQ ID NO: 3715 - DNA, 20 bp, Artificial sequence
  Synthetic oligonucleotide
caaatctgtgtgaccttggg

SEQ ID NO: 3716 - DNA, 20 bp, Artificial sequence
  Synthetic oligonucleotide
tcaaatctgtgtgaccttgg

SEQ ID NO: 3717 - DNA, 20 bp, Artificial sequence
  Synthetic oligonucleotide
ttcaaatctgtgtgaccttg

SEQ ID NO: 3718 - DNA, 20 bp, Artificial sequence
  Synthetic oligonucleotide
attcaaatctgtgtgacctt

SEQ ID NO: 3719 - DNA, 20 bp, Artificial sequence
  Synthetic oligonucleotide
ggattcaaatctgtgtgacc

SEQ ID NO: 3720 - DNA, 20 bp, Artificial sequence
  Synthetic oligonucleotide
gggattcaaatctgtgtgac

SEQ ID NO: 3721 - DNA, 20 bp, Artificial sequence
  Synthetic oligonucleotide
agggattcaaatctgtgtga

SEQ ID NO: 3722 - DNA, 20 bp, Artificial sequence
  Synthetic oligonucleotide
cagggattcaaatctgtgtg

SEQ ID NO: 3723 - DNA, 20 bp, Artificial sequence
  Synthetic oligonucleotide
gggaaaggcacaggctttgg

SEQ ID NO: 3724 - DNA, 20 bp, Artificial sequence
  Synthetic oligonucleotide
tgggaaaggcacaggctttg

SEQ ID NO: 3725 - DNA, 20 bp, Artificial sequence
  Synthetic oligonucleotide
tgtgggaaaggcacaggctt

SEQ ID NO: 3726 - DNA, 20 bp, Artificial sequence
  Synthetic oligonucleotide
aggcaaagtaacatacctgc

SEQ ID NO: 3727 - DNA, 20 bp, Artificial sequence
  Synthetic oligonucleotide
aaggcaaagtaacatacctg

SEQ ID NO: 3728 - DNA, 20 bp, Artificial sequence
  Synthetic oligonucleotide
taaggcaaagtaacatacct

SEQ ID NO: 3729 - DNA, 20 bp, Artificial sequence
  Synthetic oligonucleotide
ttaaggcaaagtaacatacc

SEQ ID NO: 3730 - DNA, 20 bp, Artificial sequence
  Synthetic oligonucleotide
ccttaaggcaaagtaacata

SEQ ID NO: 3731 - DNA, 20 bp, Artificial sequence
  Synthetic oligonucleotide
accttaaggcaaagtaacat

SEQ ID NO: 3732 - DNA, 20 bp, Artificial sequence
  Synthetic oligonucleotide
atttcttatcttcaatcctc

SEQ ID NO: 3733 - DNA, 20 bp, Artificial sequence
  Synthetic oligonucleotide
catttcttatcttcaatcct

SEQ ID NO: 3734 - DNA, 20 bp, Artificial sequence
  Synthetic oligonucleotide
tcatttcttatcttcaatcc

SEQ ID NO: 3735 - DNA, 20 bp, Artificial sequence
  Synthetic oligonucleotide
ctcatttcttatcttcaatc

SEQ ID NO: 3736 - DNA, 20 bp, Artificial sequence
  Synthetic oligonucleotide
ctctcatttcttatcttcaa

SEQ ID NO: 3737 - DNA, 20 bp, Artificial sequence
  Synthetic oligonucleotide
gctctcatttcttatcttca

SEQ ID NO: 3738 - DNA, 20 bp, Artificial sequence
  Synthetic oligonucleotide
tgctctcatttcttatcttc

SEQ ID NO: 3739 - DNA, 20 bp, Artificial sequence
  Synthetic oligonucleotide
gtgctctcatttcttatctt

SEQ ID NO: 3740 - DNA, 20 bp, Artificial sequence
  Synthetic oligonucleotide
aggtgctctcatttcttatc

SEQ ID NO: 3741 - DNA, 20 bp, Artificial sequence
  Synthetic oligonucleotide
caggtgctctcatttcttat

SEQ ID NO: 3742 - DNA, 20 bp, Artificial sequence
  Synthetic oligonucleotide
ccaggtgctctcatttctta

SEQ ID NO: 3743 - DNA, 20 bp, Artificial sequence
  Synthetic oligonucleotide
gccaggtgctctcatttctt

SEQ ID NO: 3744 - DNA, 20 bp, Artificial sequence
  Synthetic oligonucleotide
gcccatcatgaccaggccct

SEQ ID NO: 3745 - DNA, 20 bp, Artificial sequence
  Synthetic oligonucleotide
ggcccatcatgaccaggccc

SEQ ID NO: 3746 - DNA, 20 bp, Artificial sequence
  Synthetic oligonucleotide
gggcccatcatgaccaggcc

SEQ ID NO: 3747 - DNA, 20 bp, Artificial sequence
  Synthetic oligonucleotide
caggcctcgggaagcacctg

SEQ ID NO: 3748 - DNA, 20 bp, Artificial sequence
  Synthetic oligonucleotide
gcaggcctcgggaagcacct

SEQ ID NO: 3749 - DNA, 20 bp, Artificial sequence
  Synthetic oligonucleotide
agcaggcctcgggaagcacc

SEQ ID NO: 3750 - DNA, 20 bp, Artificial sequence
  Synthetic oligonucleotide
gagcaggcctcgggaagcac

SEQ ID NO: 3751 - DNA, 20 bp, Artificial sequence
  Synthetic oligonucleotide
cagaaaaagcaaccaaagca

SEQ ID NO: 3752 - DNA, 20 bp, Artificial sequence
  Synthetic oligonucleotide
gcagaaaaagcaaccaaagc

SEQ ID NO: 3753 - DNA, 20 bp, Artificial sequence
  Synthetic oligonucleotide
tgcagaaaaagcaaccaaag

SEQ ID NO: 3754 - DNA, 20 bp, Artificial sequence
  Synthetic oligonucleotide
ctgcagaaaaagcaaccaaa

SEQ ID NO: 3755 - DNA, 20 bp, Artificial sequence
  Synthetic oligonucleotide
acctgcagaaaaagcaacca

SEQ ID NO: 3756 - DNA, 20 bp, Artificial sequence
  Synthetic oligonucleotide
gacctgcagaaaaagcaacc

SEQ ID NO: 3757 - DNA, 20 bp, Artificial sequence
  Synthetic oligonucleotide
agacctgcagaaaaagcaac

SEQ ID NO: 3758 - DNA, 20 bp, Artificial sequence
  Synthetic oligonucleotide
cagacctgcagaaaaagcaa

SEQ ID NO: 3759 - DNA, 20 bp, Artificial sequence
  Synthetic oligonucleotide
acctaaggagtgagggtatc

SEQ ID NO: 3760 - DNA, 20 bp, Artificial sequence
  Synthetic oligonucleotide
aacctaaggagtgagggtat

SEQ ID NO: 3761 - DNA, 20 bp, Artificial sequence
  Synthetic oligonucleotide
caacctaaggagtgagggta

SEQ ID NO: 3762 - DNA, 20 bp, Artificial sequence
  Synthetic oligonucleotide
gcaacctaaggagtgagggt

SEQ ID NO: 3763 - DNA, 20 bp, Artificial sequence
  Synthetic oligonucleotide
tgcttgccaggtgagcttct

SEQ ID NO: 3764 - DNA, 20 bp, Artificial sequence
  Synthetic oligonucleotide
ttgcttgccaggtgagcttc

SEQ ID NO: 3765 - DNA, 20 bp, Artificial sequence
  Synthetic oligonucleotide
tttgcttgccaggtgagctt

SEQ ID NO: 3766 - DNA, 20 bp, Artificial sequence
  Synthetic oligonucleotide
ctttgcttgccaggtgagct

SEQ ID NO: 3767 - DNA, 20 bp, Artificial sequence
  Synthetic oligonucleotide
gtctttgcttgccaggtgag

SEQ ID NO: 3768 - DNA, 20 bp, Artificial sequence
  Synthetic oligonucleotide
ggtctttgcttgccaggtga

SEQ ID NO: 3769 - DNA, 20 bp, Artificial sequence
  Synthetic oligonucleotide
ccttgtattaaatactctaa

SEQ ID NO: 3770 - DNA, 20 bp, Artificial sequence
  Synthetic oligonucleotide
accttgtattaaatactcta

SEQ ID NO: 3771 - DNA, 20 bp, Artificial sequence
  Synthetic oligonucleotide
caccttgtattaaatactct

SEQ ID NO: 3772 - DNA, 20 bp, Artificial sequence
  Synthetic oligonucleotide
gcaccttgtattaaatactc

SEQ ID NO: 3773 - DNA, 20 bp, Artificial sequence
  Synthetic oligonucleotide
atgcaccttgtattaaatac

SEQ ID NO: 3774 - DNA, 20 bp, Artificial sequence
  Synthetic oligonucleotide
aatgcaccttgtattaaata

SEQ ID NO: 3775 - DNA, 20 bp, Artificial sequence
  Synthetic oligonucleotide
caatgcaccttgtattaaat

SEQ ID NO: 3776 - DNA, 20 bp, Artificial sequence
  Synthetic oligonucleotide
ccaatgcaccttgtattaaa

SEQ ID NO: 3777 - DNA, 20 bp, Artificial sequence
  Synthetic oligonucleotide
atccaatgcaccttgtatta

SEQ ID NO: 3778 - DNA, 20 bp, Artificial sequence
  Synthetic oligonucleotide
aatccaatgcaccttgtatt

SEQ ID NO: 3779 - DNA, 20 bp, Artificial sequence
  Synthetic oligonucleotide
aaatccaatgcaccttgtat

SEQ ID NO: 3780 - DNA, 20 bp, Artificial sequence
  Synthetic oligonucleotide
gaaatccaatgcaccttgta

SEQ ID NO: 3781 - DNA, 20 bp, Artificial sequence
  Synthetic oligonucleotide
ttgaaatccaatgcaccttg

SEQ ID NO: 3782 - DNA, 20 bp, Artificial sequence
  Synthetic oligonucleotide
tttgaaatccaatgcacctt

SEQ ID NO: 3783 - DNA, 20 bp, Artificial sequence
  Synthetic oligonucleotide
ctttgaaatccaatgcacct

SEQ ID NO: 3784 - DNA, 20 bp, Artificial sequence
  Synthetic oligonucleotide
cctttgaaatccaatgcacc

SEQ ID NO: 3785 - DNA, 20 bp, Artificial sequence
  Synthetic oligonucleotide
ttcctttgaaatccaatgca

SEQ ID NO: 3786 - DNA, 20 bp, Artificial sequence
  Synthetic oligonucleotide
tttcctttgaaatccaatgc

SEQ ID NO: 3787 - DNA, 20 bp, Artificial sequence
  Synthetic oligonucleotide
gtttcctttgaaatccaatg

SEQ ID NO: 3788 - DNA, 20 bp, Artificial sequence
  Synthetic oligonucleotide
agtttcctttgaaatccaat

SEQ ID NO: 3789 - DNA, 20 bp, Artificial sequence
  Synthetic oligonucleotide
ctgttactacatgtctaatc

SEQ ID NO: 3790 - DNA, 20 bp, Artificial sequence
  Synthetic oligonucleotide
cctgttactacatgtctaat

SEQ ID NO: 3791 - DNA, 20 bp, Artificial sequence
  Synthetic oligonucleotide
acctgttactacatgtctaa

SEQ ID NO: 3792 - DNA, 20 bp, Artificial sequence
  Synthetic oligonucleotide
cacctgttactacatgtcta

SEQ ID NO: 3793 - DNA, 20 bp, Artificial sequence
  Synthetic oligonucleotide
ggcacctgttactacatgtc

SEQ ID NO: 3794 - DNA, 20 bp, Artificial sequence
  Synthetic oligonucleotide
aggcacctgttactacatgt

SEQ ID NO: 3795 - DNA, 20 bp, Artificial sequence
  Synthetic oligonucleotide
aaggcacctgttactacatg

SEQ ID NO: 3796 - DNA, 20 bp, Artificial sequence
  Synthetic oligonucleotide
aaaggcacctgttactacat

SEQ ID NO: 3797 - DNA, 20 bp, Artificial sequence
  Synthetic oligonucleotide
atcacagaattatcagcagt

SEQ ID NO: 3798 - DNA, 20 bp, Artificial sequence
  Synthetic oligonucleotide
aatcacagaattatcagcag

SEQ ID NO: 3799 - DNA, 20 bp, Artificial sequence
  Synthetic oligonucleotide
aaatcacagaattatcagca

SEQ ID NO: 3800 - DNA, 20 bp, Artificial sequence
  Synthetic oligonucleotide
taaatcacagaattatcagc

SEQ ID NO: 3801 - DNA, 20 bp, Artificial sequence
  Synthetic oligonucleotide
cacacaatatccatggactt

SEQ ID NO: 3802 - DNA, 20 bp, Artificial sequence
  Synthetic oligonucleotide
acacacaatatccatggact

SEQ ID NO: 3803 - DNA, 20 bp, Artificial sequence
  Synthetic oligonucleotide
gacacacaatatccatggac

SEQ ID NO: 3804 - DNA, 20 bp, Artificial sequence
  Synthetic oligonucleotide
tgacacacaatatccatgga

SEQ ID NO: 3805 - DNA, 20 bp, Artificial sequence
  Synthetic oligonucleotide
cctgacacacaatatccatg

SEQ ID NO: 3806 - DNA, 20 bp, Artificial sequence
  Synthetic oligonucleotide
gcctgacacacaatatccat

SEQ ID NO: 3807 - DNA, 20 bp, Artificial sequence
  Synthetic oligonucleotide
agcctgacacacaatatcca

SEQ ID NO: 3808 - DNA, 20 bp, Artificial sequence
  Synthetic oligonucleotide
catgagaagcttagaaggcc

SEQ ID NO: 3809 - DNA, 20 bp, Artificial sequence
  Synthetic oligonucleotide
ctcatgagaagcttagaagg

SEQ ID NO: 3810 - DNA, 20 bp, Artificial sequence
  Synthetic oligonucleotide
gctcatgagaagcttagaag

SEQ ID NO: 3811 - DNA, 20 bp, Artificial sequence
  Synthetic oligonucleotide
gagctcatgagaagcttaga

SEQ ID NO: 3812 - DNA, 20 bp, Artificial sequence
  Synthetic oligonucleotide
tgagctcatgagaagcttag

SEQ ID NO: 3813 - DNA, 20 bp, Artificial sequence
  Synthetic oligonucleotide
ctgagctcatgagaagctta

SEQ ID NO: 3814 - DNA, 20 bp, Artificial sequence
  Synthetic oligonucleotide
gctgagctcatgagaagctt

SEQ ID NO: 3815 - DNA, 20 bp, Artificial sequence
  Synthetic oligonucleotide
ttgctgagctcatgagaagc

SEQ ID NO: 3816 - DNA, 20 bp, Artificial sequence
  Synthetic oligonucleotide
gttgctgagctcatgagaag

SEQ ID NO: 3817 - DNA, 20 bp, Artificial sequence
  Synthetic oligonucleotide
tgttgctgagctcatgagaa

SEQ ID NO: 3818 - DNA, 20 bp, Artificial sequence
  Synthetic oligonucleotide
ctgttgctgagctcatgaga

SEQ ID NO: 3819 - DNA, 20 bp, Artificial sequence
  Synthetic oligonucleotide
cactgttgctgagctcatga

SEQ ID NO: 3820 - DNA, 20 bp, Artificial sequence
  Synthetic oligonucleotide
ccactgttgctgagctcatg

SEQ ID NO: 3821 - DNA, 20 bp, Artificial sequence
  Synthetic oligonucleotide
accactgttgctgagctcat

SEQ ID NO: 3822 - DNA, 20 bp, Artificial sequence
  Synthetic oligonucleotide
aaccactgttgctgagctca

SEQ ID NO: 3823 - DNA, 20 bp, Artificial sequence
  Synthetic oligonucleotide
aaaaccactgttgctgagct

SEQ ID NO: 3824 - DNA, 20 bp, Artificial sequence
  Synthetic oligonucleotide
aaaaaccactgttgctgagc

SEQ ID NO: 3825 - DNA, 20 bp, Artificial sequence
  Synthetic oligonucleotide
taaaaaccactgttgctgag

SEQ ID NO: 3826 - DNA, 20 bp, Artificial sequence
  Synthetic oligonucleotide
gtaaaaaccactgttgctga

SEQ ID NO: 3827 - DNA, 20 bp, Artificial sequence
  Synthetic oligonucleotide
tctggttccatgctcttagg

SEQ ID NO: 3828 - DNA, 20 bp, Artificial sequence
  Synthetic oligonucleotide
ctctggttccatgctcttag

SEQ ID NO: 3829 - DNA, 20 bp, Artificial sequence
  Synthetic oligonucleotide
gctctggttccatgctctta

SEQ ID NO: 3830 - DNA, 20 bp, Artificial sequence
  Synthetic oligonucleotide
ggctctggttccatgctctt

SEQ ID NO: 3831 - DNA, 20 bp, Artificial sequence
  Synthetic oligonucleotide
caggctctggttccatgctc

SEQ ID NO: 3832 - DNA, 20 bp, Artificial sequence
  Synthetic oligonucleotide
acaggctctggttccatgct

SEQ ID NO: 3833 - DNA, 20 bp, Artificial sequence
  Synthetic oligonucleotide
aacaggctctggttccatgc

SEQ ID NO: 3834 - DNA, 20 bp, Artificial sequence
  Synthetic oligonucleotide
tgaactaaatccaccaaatg

SEQ ID NO: 3835 - DNA, 20 bp, Artificial sequence
  Synthetic oligonucleotide
atgaactaaatccaccaaat

SEQ ID NO: 3836 - DNA, 20 bp, Artificial sequence
  Synthetic oligonucleotide
gatgaactaaatccaccaaa

SEQ ID NO: 3837 - DNA, 20 bp, Artificial sequence
  Synthetic oligonucleotide
ggatgaactaaatccaccaa

SEQ ID NO: 3838 - DNA, 20 bp, Artificial sequence
  Synthetic oligonucleotide
aaggatgaactaaatccacc

SEQ ID NO: 3839 - DNA, 20 bp, Artificial sequence
  Synthetic oligonucleotide
aaaggatgaactaaatccac

SEQ ID NO: 3840 - DNA, 20 bp, Artificial sequence
  Synthetic oligonucleotide
aaaaggatgaactaaatcca

SEQ ID NO: 3841 - DNA, 20 bp, Artificial sequence
  Synthetic oligonucleotide
caaaaggatgaactaaatcc

SEQ ID NO: 3842 - DNA, 20 bp, Artificial sequence
  Synthetic oligonucleotide
agagactgaattctagcctg

SEQ ID NO: 3843 - DNA, 20 bp, Artificial sequence
  Synthetic oligonucleotide
cagagactgaattctagcct

SEQ ID NO: 3844 - DNA, 20 bp, Artificial sequence
  Synthetic oligonucleotide
ccagagactgaattctagcc

SEQ ID NO: 3845 - DNA, 20 bp, Artificial sequence
  Synthetic oligonucleotide
tccagagactgaattctagc

SEQ ID NO: 3846 - DNA, 20 bp, Artificial sequence
  Synthetic oligonucleotide
tatccagagactgaattcta

SEQ ID NO: 3847 - DNA, 20 bp, Artificial sequence
  Synthetic oligonucleotide
gtatccagagactgaattct

SEQ ID NO: 3848 - DNA, 20 bp, Artificial sequence
  Synthetic oligonucleotide
ggtatccagagactgaattc

SEQ ID NO: 3849 - DNA, 20 bp, Artificial sequence
  Synthetic oligonucleotide
gggtatccagagactgaatt

SEQ ID NO: 3850 - DNA, 20 bp, Artificial sequence
  Synthetic oligonucleotide
gtttaggctatggtctgagc

SEQ ID NO: 3851 - DNA, 20 bp, Artificial sequence
  Synthetic oligonucleotide
ggtttaggctatggtctgag

SEQ ID NO: 3852 - DNA, 20 bp, Artificial sequence
  Synthetic oligonucleotide
aggtttaggctatggtctga

SEQ ID NO: 3853 - DNA, 20 bp, Artificial sequence
  Synthetic oligonucleotide
gaggtttaggctatggtctg

SEQ ID NO: 3854 - DNA, 20 bp, Artificial sequence
  Synthetic oligonucleotide
atgaggtttaggctatggtc

SEQ ID NO: 3855 - DNA, 20 bp, Artificial sequence
  Synthetic oligonucleotide
ggatgctccaggtgggccag

SEQ ID NO: 3856 - DNA, 20 bp, Artificial sequence
  Synthetic oligonucleotide
tggatgctccaggtgggcca

SEQ ID NO: 3857 - DNA, 20 bp, Artificial sequence
  Synthetic oligonucleotide
gtggatgctccaggtgggcc

SEQ ID NO: 3858 - DNA, 20 bp, Artificial sequence
  Synthetic oligonucleotide
ggtggatgctccaggtgggc

SEQ ID NO: 3859 - DNA, 20 bp, Artificial sequence
  Synthetic oligonucleotide
gtctgcctgattccctttct

SEQ ID NO: 3860 - DNA, 20 bp, Artificial sequence
  Synthetic oligonucleotide
agtctgcctgattccctttc

SEQ ID NO: 3861 - DNA, 20 bp, Artificial sequence
  Synthetic oligonucleotide
cagtctgcctgattcccttt

SEQ ID NO: 3862 - DNA, 20 bp, Artificial sequence
  Synthetic oligonucleotide
gcagtctgcctgattccctt

SEQ ID NO: 3863 - DNA, 20 bp, Artificial sequence
  Synthetic oligonucleotide
cagcagtctgcctgattccc

SEQ ID NO: 3864 - DNA, 20 bp, Artificial sequence
  Synthetic oligonucleotide
tcagcagtctgcctgattcc

SEQ ID NO: 3865 - DNA, 20 bp, Artificial sequence
  Synthetic oligonucleotide
ttcagcagtctgcctgattc

SEQ ID NO: 3866 - DNA, 20 bp, Artificial sequence
  Synthetic oligonucleotide
gttcagcagtctgcctgatt

SEQ ID NO: 3867 - DNA, 20 bp, Artificial sequence
  Synthetic oligonucleotide
ctgttcagcagtctgcctga

SEQ ID NO: 3868 - DNA, 20 bp, Artificial sequence
  Synthetic oligonucleotide
actgttcagcagtctgcctg

SEQ ID NO: 3869 - DNA, 20 bp, Artificial sequence
  Synthetic oligonucleotide
tactgttcagcagtctgcct

SEQ ID NO: 3870 - DNA, 20 bp, Artificial sequence
  Synthetic oligonucleotide
ttactgttcagcagtctgcc

SEQ ID NO: 3871 - DNA, 20 bp, Artificial sequence
  Synthetic oligonucleotide
acttactgttcagcagtctg

SEQ ID NO: 3872 - DNA, 20 bp, Artificial sequence
  Synthetic oligonucleotide
tacttactgttcagcagtct

SEQ ID NO: 3873 - DNA, 20 bp, Artificial sequence
  Synthetic oligonucleotide
atacttactgttcagcagtc

SEQ ID NO: 3874 - DNA, 20 bp, Artificial sequence
  Synthetic oligonucleotide
catacttactgttcagcagt

SEQ ID NO: 3875 - DNA, 20 bp, Artificial sequence
  Synthetic oligonucleotide
gtcatacttactgttcagca

SEQ ID NO: 3876 - DNA, 20 bp, Artificial sequence
  Synthetic oligonucleotide
agtcatacttactgttcagc

SEQ ID NO: 3877 - DNA, 20 bp, Artificial sequence
  Synthetic oligonucleotide
aagtcatacttactgttcag

SEQ ID NO: 3878 - DNA, 20 bp, Artificial sequence
  Synthetic oligonucleotide
aaagtcatacttactgttca

SEQ ID NO: 3879 - DNA, 20 bp, Artificial sequence
  Synthetic oligonucleotide
tggtgaatagctatgtctaa

SEQ ID NO: 3880 - DNA, 20 bp, Artificial sequence
  Synthetic oligonucleotide
ttggtgaatagctatgtcta

SEQ ID NO: 3881 - DNA, 20 bp, Artificial sequence
  Synthetic oligonucleotide
cttggtgaatagctatgtct

SEQ ID NO: 3882 - DNA, 20 bp, Artificial sequence
  Synthetic oligonucleotide
gcttggtgaatagctatgtc

SEQ ID NO: 3883 - DNA, 20 bp, Artificial sequence
  Synthetic oligonucleotide
tagcttggtgaatagctatg

SEQ ID NO: 3884 - DNA, 20 bp, Artificial sequence
  Synthetic oligonucleotide
gtagcttggtgaatagctat

SEQ ID NO: 3885 - DNA, 20 bp, Artificial sequence
  Synthetic oligonucleotide
ggtagcttggtgaatagcta

SEQ ID NO: 3886 - DNA, 20 bp, Artificial sequence
  Synthetic oligonucleotide
agcctacaagagcctgttaa

SEQ ID NO: 3887 - DNA, 20 bp, Artificial sequence
  Synthetic oligonucleotide
cagcctacaagagcctgtta

SEQ ID NO: 3888 - DNA, 20 bp, Artificial sequence
  Synthetic oligonucleotide
gcagcctacaagagcctgtt

SEQ ID NO: 3889 - DNA, 20 bp, Artificial sequence
  Synthetic oligonucleotide
tgcagcctacaagagcctgt

SEQ ID NO: 3890 - DNA, 20 bp, Artificial sequence
  Synthetic oligonucleotide
tgtgcagcctacaagagcct

SEQ ID NO: 3891 - DNA, 20 bp, Artificial sequence
  Synthetic oligonucleotide
atgtgcagcctacaagagcc

SEQ ID NO: 3892 - DNA, 20 bp, Artificial sequence
  Synthetic oligonucleotide
catgtgcagcctacaagagc

SEQ ID NO: 3893 - DNA, 20 bp, Artificial sequence
  Synthetic oligonucleotide
gcatgtgcagcctacaagag

SEQ ID NO: 3894 - DNA, 20 bp, Artificial sequence
  Synthetic oligonucleotide
aagcatgtgcagcctacaag

SEQ ID NO: 3895 - DNA, 20 bp, Artificial sequence
  Synthetic oligonucleotide
gaagcatgtgcagcctacaa

SEQ ID NO: 3896 - DNA, 20 bp, Artificial sequence
  Synthetic oligonucleotide
ggaagcatgtgcagcctaca

SEQ ID NO: 3897 - DNA, 20 bp, Artificial sequence
  Synthetic oligonucleotide
gggaagcatgtgcagcctac

SEQ ID NO: 3898 - DNA, 20 bp, Artificial sequence
  Synthetic oligonucleotide
tagggaagcatgtgcagcct

SEQ ID NO: 3899 - DNA, 20 bp, Artificial sequence
  Synthetic oligonucleotide
ctagggaagcatgtgcagcc

SEQ ID NO: 3900 - DNA, 20 bp, Artificial sequence
  Synthetic oligonucleotide
tctagggaagcatgtgcagc

SEQ ID NO: 3901 - DNA, 20 bp, Artificial sequence
  Synthetic oligonucleotide
ttctagggaagcatgtgcag

SEQ ID NO: 3902 - DNA, 20 bp, Artificial sequence
  Synthetic oligonucleotide
gtttctagggaagcatgtgc

SEQ ID NO: 3903 - DNA, 20 bp, Artificial sequence
  Synthetic oligonucleotide
agtttctagggaagcatgtg

SEQ ID NO: 3904 - DNA, 20 bp, Artificial sequence
  Synthetic oligonucleotide
aagtttctagggaagcatgt

SEQ ID NO: 3905 - DNA, 20 bp, Artificial sequence
  Synthetic oligonucleotide
caagtttctagggaagcatg

SEQ ID NO: 3906 - DNA, 20 bp, Artificial sequence
  Synthetic oligonucleotide
tacaactctcttgttgggag

SEQ ID NO: 3907 - DNA, 20 bp, Artificial sequence
  Synthetic oligonucleotide
gtacaactctcttgttggga

SEQ ID NO: 3908 - DNA, 20 bp, Artificial sequence
  Synthetic oligonucleotide
ggtacaactctcttgttggg

SEQ ID NO: 3909 - DNA, 20 bp, Artificial sequence
  Synthetic oligonucleotide
gggtacaactctcttgttgg

SEQ ID NO: 3910 - DNA, 20 bp, Artificial sequence
  Synthetic oligonucleotide
cagggtacaactctcttgtt

SEQ ID NO: 3911 - DNA, 20 bp, Artificial sequence
  Synthetic oligonucleotide
acagggtacaactctcttgt

SEQ ID NO: 3912 - DNA, 20 bp, Artificial sequence
  Synthetic oligonucleotide
aacagggtacaactctcttg

SEQ ID NO: 3913 - DNA, 20 bp, Artificial sequence
  Synthetic oligonucleotide
aaacagggtacaactctctt

SEQ ID NO: 3914 - DNA, 20 bp, Artificial sequence
  Synthetic oligonucleotide
aaaaacagggtacaactctc

SEQ ID NO: 3915 - DNA, 20 bp, Artificial sequence
  Synthetic oligonucleotide
taaaaacagggtacaactct

SEQ ID NO: 3916 - DNA, 20 bp, Artificial sequence
  Synthetic oligonucleotide
ctaaaaacagggtacaactc

SEQ ID NO: 3917 - DNA, 20 bp, Artificial sequence
  Synthetic oligonucleotide
gctaaaaacagggtacaact

SEQ ID NO: 3918 - DNA, 20 bp, Artificial sequence
  Synthetic oligonucleotide
tgtagactctccatgagcct

SEQ ID NO: 3919 - DNA, 20 bp, Artificial sequence
  Synthetic oligonucleotide
atgtagactctccatgagcc

SEQ ID NO: 3920 - DNA, 20 bp, Artificial sequence
  Synthetic oligonucleotide
gatgtagactctccatgagc

SEQ ID NO: 3921 - DNA, 20 bp, Artificial sequence
  Synthetic oligonucleotide
ggatgtagactctccatgag

SEQ ID NO: 3922 - DNA, 20 bp, Artificial sequence
  Synthetic oligonucleotide
taagctaggcacacccaggg

SEQ ID NO: 3923 - DNA, 20 bp, Artificial sequence
  Synthetic oligonucleotide
ctaagctaggcacacccagg

SEQ ID NO: 3924 - DNA, 20 bp, Artificial sequence
  Synthetic oligonucleotide
actaagctaggcacacccag

SEQ ID NO: 3925 - DNA, 20 bp, Artificial sequence
  Synthetic oligonucleotide
cactaagctaggcacaccca

SEQ ID NO: 3926 - DNA, 20 bp, Artificial sequence
  Synthetic oligonucleotide
ggcactaagctaggcacacc

SEQ ID NO: 3927 - DNA, 20 bp, Artificial sequence
  Synthetic oligonucleotide
gtggcactaagctaggcaca

SEQ ID NO: 3928 - DNA, 20 bp, Artificial sequence
  Synthetic oligonucleotide
tgtggcactaagctaggcac

SEQ ID NO: 3929 - DNA, 20 bp, Artificial sequence
  Synthetic oligonucleotide
actgtggcactaagctaggc

SEQ ID NO: 3930 - DNA, 20 bp, Artificial sequence
  Synthetic oligonucleotide
tactgtggcactaagctagg

SEQ ID NO: 3931 - DNA, 20 bp, Artificial sequence
  Synthetic oligonucleotide
ttactgtggcactaagctag

SEQ ID NO: 3932 - DNA, 20 bp, Artificial sequence
  Synthetic oligonucleotide
tttactgtggcactaagcta

SEQ ID NO: 3933 - DNA, 20 bp, Artificial sequence
  Synthetic oligonucleotide
tgtttactgtggcactaagc

SEQ ID NO: 3934 - DNA, 20 bp, Artificial sequence
  Synthetic oligonucleotide
gtgtttactgtggcactaag

SEQ ID NO: 3935 - DNA, 20 bp, Artificial sequence
  Synthetic oligonucleotide
agtgtttactgtggcactaa

SEQ ID NO: 3936 - DNA, 20 bp, Artificial sequence
  Synthetic oligonucleotide
gagtgtttactgtggcacta

SEQ ID NO: 3937 - DNA, 20 bp, Artificial sequence
  Synthetic oligonucleotide
atggatactcagaagagcag

SEQ ID NO: 3938 - DNA, 20 bp, Artificial sequence
  Synthetic oligonucleotide
gatggatactcagaagagca

SEQ ID NO: 3939 - DNA, 20 bp, Artificial sequence
  Synthetic oligonucleotide
acctcagggctggcccaaag

SEQ ID NO: 3940 - DNA, 20 bp, Artificial sequence
  Synthetic oligonucleotide
gacctcagggctggcccaaa

SEQ ID NO: 3941 - DNA, 20 bp, Artificial sequence
  Synthetic oligonucleotide
ggacctcagggctggcccaa

SEQ ID NO: 3942 - DNA, 20 bp, Artificial sequence
  Synthetic oligonucleotide
aggacctcagggctggccca

SEQ ID NO: 3943 - DNA, 20 bp, Artificial sequence
  Synthetic oligonucleotide
tcaggacctcagggctggcc

SEQ ID NO: 3944 - DNA, 20 bp, Artificial sequence
  Synthetic oligonucleotide
gtcaggacctcagggctggc

SEQ ID NO: 3945 - DNA, 20 bp, Artificial sequence
  Synthetic oligonucleotide
tgtcaggacctcagggctgg

SEQ ID NO: 3946 - DNA, 20 bp, Artificial sequence
  Synthetic oligonucleotide
ctgtcaggacctcagggctg

SEQ ID NO: 3947 - DNA, 20 bp, Artificial sequence
  Synthetic oligonucleotide
gagttatcctcaattcacca

SEQ ID NO: 3948 - DNA, 20 bp, Artificial sequence
  Synthetic oligonucleotide
agagttatcctcaattcacc

SEQ ID NO: 3949 - DNA, 20 bp, Artificial sequence
  Synthetic oligonucleotide
ccagagttatcctcaattca

SEQ ID NO: 3950 - DNA, 20 bp, Artificial sequence
  Synthetic oligonucleotide
tgccagagttatcctcaatt

SEQ ID NO: 3951 - DNA, 20 bp, Artificial sequence
  Synthetic oligonucleotide
ctgccagagttatcctcaat

SEQ ID NO: 3952 - DNA, 20 bp, Artificial sequence
  Synthetic oligonucleotide
cctgccagagttatcctcaa

SEQ ID NO: 3953 - DNA, 20 bp, Artificial sequence
  Synthetic oligonucleotide
tcctgccagagttatcctca

SEQ ID NO: 3954 - DNA, 20 bp, Artificial sequence
  Synthetic oligonucleotide
gatcctgccagagttatcct

SEQ ID NO: 3955 - DNA, 20 bp, Artificial sequence
  Synthetic oligonucleotide
ggatcctgccagagttatcc

SEQ ID NO: 3956 - DNA, 20 bp, Artificial sequence
  Synthetic oligonucleotide
aggatcctgccagagttatc

SEQ ID NO: 3957 - DNA, 20 bp, Artificial sequence
  Synthetic oligonucleotide
caggatcctgccagagttat

SEQ ID NO: 3958 - DNA, 20 bp, Artificial sequence
  Synthetic oligonucleotide
cagcaaatatacaccaccct

SEQ ID NO: 3959 - DNA, 20 bp, Artificial sequence
  Synthetic oligonucleotide
acagcaaatatacaccaccc

SEQ ID NO: 3960 - DNA, 20 bp, Artificial sequence
  Synthetic oligonucleotide
aacagcaaatatacaccacc

SEQ ID NO: 3961 - DNA, 20 bp, Artificial sequence
  Synthetic oligonucleotide
caacagcaaatatacaccac

SEQ ID NO: 3962 - DNA, 20 bp, Artificial sequence
  Synthetic oligonucleotide
cacaacagcaaatatacacc

SEQ ID NO: 3963 - DNA, 20 bp, Artificial sequence
  Synthetic oligonucleotide
tcacaacagcaaatatacac

SEQ ID NO: 3964 - DNA, 20 bp, Artificial sequence
  Synthetic oligonucleotide
ctcacaacagcaaatataca

SEQ ID NO: 3965 - DNA, 20 bp, Artificial sequence
  Synthetic oligonucleotide
actcacaacagcaaatatac

SEQ ID NO: 3966 - DNA, 20 bp, Artificial sequence
  Synthetic oligonucleotide
tgactcacaacagcaaatat

SEQ ID NO: 3967 - DNA, 20 bp, Artificial sequence
  Synthetic oligonucleotide
ctgactcacaacagcaaata

SEQ ID NO: 3968 - DNA, 20 bp, Artificial sequence
  Synthetic oligonucleotide
actgactcacaacagcaaat

SEQ ID NO: 3969 - DNA, 20 bp, Artificial sequence
  Synthetic oligonucleotide
cactgactcacaacagcaaa

SEQ ID NO: 3970 - DNA, 20 bp, Artificial sequence
  Synthetic oligonucleotide
gtcactgactcacaacagca

SEQ ID NO: 3971 - DNA, 20 bp, Artificial sequence
  Synthetic oligonucleotide
agtcactgactcacaacagc

SEQ ID NO: 3972 - DNA, 20 bp, Artificial sequence
  Synthetic oligonucleotide
cagtcactgactcacaacag

SEQ ID NO: 3973 - DNA, 20 bp, Artificial sequence
  Synthetic oligonucleotide
tcagtcactgactcacaaca

SEQ ID NO: 3974 - DNA, 20 bp, Artificial sequence
  Synthetic oligonucleotide
tctcagtcactgactcacaa

SEQ ID NO: 3975 - DNA, 20 bp, Artificial sequence
  Synthetic oligonucleotide
atctcagtcactgactcaca

SEQ ID NO: 3976 - DNA, 20 bp, Artificial sequence
  Synthetic oligonucleotide
gatctcagtcactgactcac

SEQ ID NO: 3977 - DNA, 20 bp, Artificial sequence
  Synthetic oligonucleotide
ggatctcagtcactgactca

SEQ ID NO: 3978 - DNA, 20 bp, Artificial sequence
  Synthetic oligonucleotide
ggttacccagccactgcccc

SEQ ID NO: 3979 - DNA, 20 bp, Artificial sequence
  Synthetic oligonucleotide
gggttacccagccactgccc

SEQ ID NO: 3980 - DNA, 20 bp, Artificial sequence
  Synthetic oligonucleotide
agggttacccagccactgcc

SEQ ID NO: 3981 - DNA, 20 bp, Artificial sequence
  Synthetic oligonucleotide
cagggttacccagccactgc

SEQ ID NO: 3982 - DNA, 20 bp, Artificial sequence
  Synthetic oligonucleotide
tgcagggttacccagccact

SEQ ID NO: 3983 - DNA, 20 bp, Artificial sequence
  Synthetic oligonucleotide
atgcagggttacccagccac

SEQ ID NO: 3984 - DNA, 20 bp, Artificial sequence
  Synthetic oligonucleotide
gatgcagggttacccagcca

SEQ ID NO: 3985 - DNA, 20 bp, Artificial sequence
  Synthetic oligonucleotide
ggatgcagggttacccagcc

SEQ ID NO: 3986 - DNA, 20 bp, Artificial sequence
  Synthetic oligonucleotide
aaggatgcagggttacccag

SEQ ID NO: 3987 - DNA, 20 bp, Artificial sequence
  Synthetic oligonucleotide
gaaggatgcagggttaccca

SEQ ID NO: 3988 - DNA, 20 bp, Artificial sequence
  Synthetic oligonucleotide
tgaaggatgcagggttaccc

SEQ ID NO: 3989 - DNA, 20 bp, Artificial sequence
  Synthetic oligonucleotide
gtgaaggatgcagggttacc

SEQ ID NO: 3990 - DNA, 20 bp, Artificial sequence
  Synthetic oligonucleotide
atcttcattacatgattact

SEQ ID NO: 3991 - DNA, 20 bp, Artificial sequence
  Synthetic oligonucleotide
gatcttcattacatgattac

SEQ ID NO: 3992 - DNA, 20 bp, Artificial sequence
  Synthetic oligonucleotide
agatcttcattacatgatta

SEQ ID NO: 3993 - DNA, 20 bp, Artificial sequence
  Synthetic oligonucleotide
cagatcttcattacatgatt

SEQ ID NO: 3994 - DNA, 20 bp, Artificial sequence
  Synthetic oligonucleotide
ggcagatcttcattacatga

SEQ ID NO: 3995 - DNA, 20 bp, Artificial sequence
  Synthetic oligonucleotide
atggacaggtgattctaagc

SEQ ID NO: 3996 - DNA, 20 bp, Artificial sequence
  Synthetic oligonucleotide
gatggacaggtgattctaag

SEQ ID NO: 3997 - DNA, 20 bp, Artificial sequence
  Synthetic oligonucleotide
cagatggacaggtgattcta

SEQ ID NO: 3998 - DNA, 20 bp, Artificial sequence
  Synthetic oligonucleotide
ggcagatggacaggtgattc

SEQ ID NO: 3999 - DNA, 20 bp, Artificial sequence
  Synthetic oligonucleotide
aggcagatggacaggtgatt

SEQ ID NO: 4000 - DNA, 20 bp, Artificial sequence
  Synthetic oligonucleotide
gaggcagatggacaggtgat

SEQ ID NO: 4001 - DNA, 20 bp, Artificial sequence
  Synthetic oligonucleotide
tgaggcagatggacaggtga

SEQ ID NO: 4002 - DNA, 20 bp, Artificial sequence
  Synthetic oligonucleotide
gtgaccttgggatagtccct

SEQ ID NO: 4003 - DNA, 20 bp, Artificial sequence
  Synthetic oligonucleotide
tgtgaccttgggatagtccc

SEQ ID NO: 4004 - DNA, 20 bp, Artificial sequence
  Synthetic oligonucleotide
ttgtgaccttgggatagtcc

SEQ ID NO: 4005 - DNA, 20 bp, Artificial sequence
  Synthetic oligonucleotide
tttgtgaccttgggatagtc

SEQ ID NO: 4006 - DNA, 20 bp, Artificial sequence
  Synthetic oligonucleotide
gagcaaaggcttgcttaagt

SEQ ID NO: 4007 - DNA, 20 bp, Artificial sequence
  Synthetic oligonucleotide
agagcaaaggcttgcttaag

SEQ ID NO: 4008 - DNA, 20 bp, Artificial sequence
  Synthetic oligonucleotide
aagagcaaaggcttgcttaa

SEQ ID NO: 4009 - DNA, 20 bp, Artificial sequence
  Synthetic oligonucleotide
gaagagcaaaggcttgctta

SEQ ID NO: 4010 - DNA, 20 bp, Artificial sequence
  Synthetic oligonucleotide
cagaagagcaaaggcttgct

SEQ ID NO: 4011 - DNA, 20 bp, Artificial sequence
  Synthetic oligonucleotide
acagaagagcaaaggcttgc

SEQ ID NO: 4012 - DNA, 20 bp, Artificial sequence
  Synthetic oligonucleotide
cacagaagagcaaaggcttg

SEQ ID NO: 4013 - DNA, 20 bp, Artificial sequence
  Synthetic oligonucleotide
ccacagaagagcaaaggctt

SEQ ID NO: 4014 - DNA, 20 bp, Artificial sequence
  Synthetic oligonucleotide
acccacagaagagcaaaggc

SEQ ID NO: 4015 - DNA, 20 bp, Artificial sequence
  Synthetic oligonucleotide
gacccacagaagagcaaagg

SEQ ID NO: 4016 - DNA, 20 bp, Artificial sequence
  Synthetic oligonucleotide
agacccacagaagagcaaag

SEQ ID NO: 4017 - DNA, 20 bp, Artificial sequence
  Synthetic oligonucleotide
cagacccacagaagagcaaa

SEQ ID NO: 4018 - DNA, 20 bp, Artificial sequence
  Synthetic oligonucleotide
atgcccttgctgtaggaccc

SEQ ID NO: 4019 - DNA, 20 bp, Artificial sequence
  Synthetic oligonucleotide
aatgcccttgctgtaggacc

SEQ ID NO: 4020 - DNA, 20 bp, Artificial sequence
  Synthetic oligonucleotide
caatgcccttgctgtaggac

SEQ ID NO: 4021 - DNA, 20 bp, Artificial sequence
  Synthetic oligonucleotide
tcaatgcccttgctgtagga

SEQ ID NO: 4022 - DNA, 20 bp, Artificial sequence
  Synthetic oligonucleotide
ttagctctcagtgaagctgg

SEQ ID NO: 4023 - DNA, 20 bp, Artificial sequence
  Synthetic oligonucleotide
aacagcagcagtctaatcca

SEQ ID NO: 4024 - DNA, 20 bp, Artificial sequence
  Synthetic oligonucleotide
aaacagcagcagtctaatcc

SEQ ID NO: 4025 - DNA, 20 bp, Artificial sequence
  Synthetic oligonucleotide
gaaacagcagcagtctaatc

SEQ ID NO: 4026 - DNA, 20 bp, Artificial sequence
  Synthetic oligonucleotide
ggaaacagcagcagtctaat

SEQ ID NO: 4027 - DNA, 20 bp, Artificial sequence
  Synthetic oligonucleotide
aactctcagctactccccaa

SEQ ID NO: 4028 - DNA, 20 bp, Artificial sequence
  Synthetic oligonucleotide
caactctcagctactcccca

SEQ ID NO: 4029 - DNA, 20 bp, Artificial sequence
  Synthetic oligonucleotide
ccaactctcagctactcccc

SEQ ID NO: 4030 - DNA, 20 bp, Artificial sequence
  Synthetic oligonucleotide
accaactctcagctactccc

SEQ ID NO: 4031 - DNA, 20 bp, Artificial sequence
  Synthetic oligonucleotide
gcaaacagattaaagttgct

SEQ ID NO: 4032 - DNA, 20 bp, Artificial sequence
  Synthetic oligonucleotide
ggcaaacagattaaagttgc

SEQ ID NO: 4033 - DNA, 20 bp, Artificial sequence
  Synthetic oligonucleotide
cacctgagtgctgcaaagtg

SEQ ID NO: 4034 - DNA, 20 bp, Artificial sequence
  Synthetic oligonucleotide
ccacctgagtgctgcaaagt

SEQ ID NO: 4035 - DNA, 20 bp, Artificial sequence
  Synthetic oligonucleotide
cccacctgagtgctgcaaag

SEQ ID NO: 4036 - DNA, 20 bp, Artificial sequence
  Synthetic oligonucleotide
tcccacctgagtgctgcaaa

SEQ ID NO: 4037 - DNA, 20 bp, Artificial sequence
  Synthetic oligonucleotide
actcccacctgagtgctgca

SEQ ID NO: 4038 - DNA, 20 bp, Artificial sequence
  Synthetic oligonucleotide
cactcccacctgagtgctgc

SEQ ID NO: 4039 - DNA, 20 bp, Artificial sequence
  Synthetic oligonucleotide
acactcccacctgagtgctg

SEQ ID NO: 4040 - DNA, 20 bp, Artificial sequence
  Synthetic oligonucleotide
gacactcccacctgagtgct

SEQ ID NO: 4041 - DNA, 20 bp, Artificial sequence
  Synthetic oligonucleotide
tttttggctgccctgcctca

SEQ ID NO: 4042 - DNA, 20 bp, Artificial sequence
  Synthetic oligonucleotide
ctttttggctgccctgcctc

SEQ ID NO: 4043 - DNA, 20 bp, Artificial sequence
  Synthetic oligonucleotide
tctttttggctgccctgcct

SEQ ID NO: 4044 - DNA, 20 bp, Artificial sequence
  Synthetic oligonucleotide
gtctttttggctgccctgcc

SEQ ID NO: 4045 - DNA, 20 bp, Artificial sequence
  Synthetic oligonucleotide
tggtctttttggctgccctg

SEQ ID NO: 4046 - DNA, 20 bp, Artificial sequence
  Synthetic oligonucleotide
ttggtctttttggctgccct

SEQ ID NO: 4047 - DNA, 20 bp, Artificial sequence
  Synthetic oligonucleotide
gttggtctttttggctgccc

SEQ ID NO: 4048 - DNA, 20 bp, Artificial sequence
  Synthetic oligonucleotide
cgttggtctttttggctgcc

SEQ ID NO: 4049 - DNA, 20 bp, Artificial sequence
  Synthetic oligonucleotide
cttatctttgtccacatatc

SEQ ID NO: 4050 - DNA, 20 bp, Artificial sequence
  Synthetic oligonucleotide
ccttatctttgtccacatat

SEQ ID NO: 4051 - DNA, 20 bp, Artificial sequence
  Synthetic oligonucleotide
accttatctttgtccacata

SEQ ID NO: 4052 - DNA, 20 bp, Artificial sequence
  Synthetic oligonucleotide
taccttatctttgtccacat

SEQ ID NO: 4053 - DNA, 20 bp, Artificial sequence
  Synthetic oligonucleotide
aataccttatctttgtccac

SEQ ID NO: 4054 - DNA, 20 bp, Artificial sequence
  Synthetic oligonucleotide
aaataccttatctttgtcca

SEQ ID NO: 4055 - DNA, 20 bp, Artificial sequence
  Synthetic oligonucleotide
taaataccttatctttgtcc

SEQ ID NO: 4056 - DNA, 20 bp, Artificial sequence
  Synthetic oligonucleotide
ataaataccttatctttgtc

SEQ ID NO: 4057 - DNA, 20 bp, Artificial sequence
  Synthetic oligonucleotide
caataaataccttatctttg

SEQ ID NO: 4058 - DNA, 20 bp, Artificial sequence
  Synthetic oligonucleotide
tcaataaataccttatcttt

SEQ ID NO: 4059 - DNA, 20 bp, Artificial sequence
  Synthetic oligonucleotide
ttcaataaataccttatctt

SEQ ID NO: 4060 - DNA, 20 bp, Artificial sequence
  Synthetic oligonucleotide
cttcaataaataccttatct

SEQ ID NO: 4061 - DNA, 20 bp, Artificial sequence
  Synthetic oligonucleotide
tgcttcaataaataccttat

SEQ ID NO: 4062 - DNA, 20 bp, Artificial sequence
  Synthetic oligonucleotide
atgcttcaataaatacctta

SEQ ID NO: 4063 - DNA, 20 bp, Artificial sequence
  Synthetic oligonucleotide
aatgcttcaataaatacctt

SEQ ID NO: 4064 - DNA, 20 bp, Artificial sequence
  Synthetic oligonucleotide
taatgcttcaataaatacct

SEQ ID NO: 4065 - DNA, 20 bp, Artificial sequence
  Synthetic oligonucleotide
ttagaagtaatgcttcaata

SEQ ID NO: 4066 - DNA, 20 bp, Artificial sequence
  Synthetic oligonucleotide
cttagaagtaatgcttcaat

SEQ ID NO: 4067 - DNA, 20 bp, Artificial sequence
  Synthetic oligonucleotide
tcttagaagtaatgcttcaa

SEQ ID NO: 4068 - DNA, 20 bp, Artificial sequence
  Synthetic oligonucleotide
ctcttagaagtaatgcttca

SEQ ID NO: 4069 - DNA, 20 bp, Artificial sequence
  Synthetic oligonucleotide
ccctcttagaagtaatgctt

SEQ ID NO: 4070 - DNA, 20 bp, Artificial sequence
  Synthetic oligonucleotide
tccctcttagaagtaatgct

SEQ ID NO: 4071 - DNA, 20 bp, Artificial sequence
  Synthetic oligonucleotide
ttccctcttagaagtaatgc

SEQ ID NO: 4072 - DNA, 20 bp, Artificial sequence
  Synthetic oligonucleotide
tttccctcttagaagtaatg

SEQ ID NO: 4073 - DNA, 20 bp, Artificial sequence
  Synthetic oligonucleotide
gctaatgatacaaggttgtt

SEQ ID NO: 4074 - DNA, 20 bp, Artificial sequence
  Synthetic oligonucleotide
agctaatgatacaaggttgt

SEQ ID NO: 4075 - DNA, 20 bp, Artificial sequence
  Synthetic oligonucleotide
gcagctaatgatacaaggtt

SEQ ID NO: 4076 - DNA, 20 bp, Artificial sequence
  Synthetic oligonucleotide
atgcagctaatgatacaagg

SEQ ID NO: 4077 - DNA, 20 bp, Artificial sequence
  Synthetic oligonucleotide
aatgcagctaatgatacaag

SEQ ID NO: 4078 - DNA, 20 bp, Artificial sequence
  Synthetic oligonucleotide
aaatgcagctaatgatacaa

SEQ ID NO: 4079 - DNA, 20 bp, Artificial sequence
  Synthetic oligonucleotide
aaaatgcagctaatgataca

SEQ ID NO: 4080 - DNA, 20 bp, Artificial sequence
  Synthetic oligonucleotide
aagagttacctcctccctgg

SEQ ID NO: 4081 - DNA, 20 bp, Artificial sequence
  Synthetic oligonucleotide
caagagttacctcctccctg

SEQ ID NO: 4082 - DNA, 20 bp, Artificial sequence
  Synthetic oligonucleotide
gcaagagttacctcctccct

SEQ ID NO: 4083 - DNA, 20 bp, Artificial sequence
  Synthetic oligonucleotide
tgcaagagttacctcctccc

SEQ ID NO: 4084 - DNA, 20 bp, Artificial sequence
  Synthetic oligonucleotide
ttctactcaaaaatatacat

SEQ ID NO: 4085 - DNA, 20 bp, Artificial sequence
  Synthetic oligonucleotide
atgagtaagggtattctgct

SEQ ID NO: 4086 - DNA, 20 bp, Artificial sequence
  Synthetic oligonucleotide
aatgagtaagggtattctgc

SEQ ID NO: 4087 - DNA, 20 bp, Artificial sequence
  Synthetic oligonucleotide
caatgagtaagggtattctg

SEQ ID NO: 4088 - DNA, 20 bp, Artificial sequence
  Synthetic oligonucleotide
acaatgagtaagggtattct

SEQ ID NO: 4089 - DNA, 20 bp, Artificial sequence
  Synthetic oligonucleotide
cagccctgtgccagccagcc

SEQ ID NO: 4090 - DNA, 20 bp, Artificial sequence
  Synthetic oligonucleotide
acagccctgtgccagccagc

SEQ ID NO: 4091 - DNA, 20 bp, Artificial sequence
  Synthetic oligonucleotide
gacagccctgtgccagccag

SEQ ID NO: 4092 - DNA, 20 bp, Artificial sequence
  Synthetic oligonucleotide
cgacagccctgtgccagcca

SEQ ID NO: 4093 - DNA, 20 bp, Artificial sequence
  Synthetic oligonucleotide
actttcccacagtcagctgg

SEQ ID NO: 4094 - DNA, 20 bp, Artificial sequence
  Synthetic oligonucleotide
aactttcccacagtcagctg

SEQ ID NO: 4095 - DNA, 20 bp, Artificial sequence
  Synthetic oligonucleotide
aaactttcccacagtcagct

SEQ ID NO: 4096 - DNA, 20 bp, Artificial sequence
  Synthetic oligonucleotide
gaaactttcccacagtcagc

SEQ ID NO: 4097 - DNA, 20 bp, Artificial sequence
  Synthetic oligonucleotide
tggaaactttcccacagtca

SEQ ID NO: 4098 - DNA, 20 bp, Artificial sequence
  Synthetic oligonucleotide
atggaaactttcccacagtc

SEQ ID NO: 4099 - DNA, 20 bp, Artificial sequence
  Synthetic oligonucleotide
aatggaaactttcccacagt

SEQ ID NO: 4100 - DNA, 20 bp, Artificial sequence
  Synthetic oligonucleotide
aaatggaaactttcccacag

SEQ ID NO: 4101 - DNA, 20 bp, Artificial sequence
  Synthetic oligonucleotide
aaatccaacccttgtcactc

SEQ ID NO: 4102 - DNA, 20 bp, Artificial sequence
  Synthetic oligonucleotide
caaatccaacccttgtcact

SEQ ID NO: 4103 - DNA, 20 bp, Artificial sequence
  Synthetic oligonucleotide
tcaaatccaacccttgtcac

SEQ ID NO: 4104 - DNA, 20 bp, Artificial sequence
  Synthetic oligonucleotide
ctcaaatccaacccttgtca

SEQ ID NO: 4105 - DNA, 20 bp, Artificial sequence
  Synthetic oligonucleotide
tggatgtgtcatttcccctg

SEQ ID NO: 4106 - DNA, 20 bp, Artificial sequence
  Synthetic oligonucleotide
agtgcaagagttacctcctc

SEQ ID NO: 4107 - DNA, 20 bp, Artificial sequence
  Synthetic oligonucleotide
cagtgcaagagttacctcct

SEQ ID NO: 4108 - DNA, 20 bp, Artificial sequence
  Synthetic oligonucleotide
gcagtgcaagagttacctcc

SEQ ID NO: 4109 - DNA, 20 bp, Artificial sequence
  Synthetic oligonucleotide
agcagtgcaagagttacctc

SEQ ID NO: 4110 - DNA, 20 bp, Artificial sequence
  Synthetic oligonucleotide
atcagttagcagtgcaagag

SEQ ID NO: 4111 - DNA, 20 bp, Artificial sequence
  Synthetic oligonucleotide
tatcagttagcagtgcaaga

SEQ ID NO: 4112 - DNA, 20 bp, Artificial sequence
  Synthetic oligonucleotide
ctatcagttagcagtgcaag

SEQ ID NO: 4113 - DNA, 20 bp, Artificial sequence
  Synthetic oligonucleotide
cctatcagttagcagtgcaa

SEQ ID NO: 4114 - DNA, 20 bp, Artificial sequence
  Synthetic oligonucleotide
ttcctatcagttagcagtgc

SEQ ID NO: 4115 - DNA, 20 bp, Artificial sequence
  Synthetic oligonucleotide
attcctatcagttagcagtg

SEQ ID NO: 4116 - DNA, 20 bp, Artificial sequence
  Synthetic oligonucleotide
aattcctatcagttagcagt

SEQ ID NO: 4117 - DNA, 20 bp, Artificial sequence
  Synthetic oligonucleotide
taattcctatcagttagcag

SEQ ID NO: 4118 - DNA, 20 bp, Artificial sequence
  Synthetic oligonucleotide
tctatgctgcagtcatatta

SEQ ID NO: 4119 - DNA, 20 bp, Artificial sequence
  Synthetic oligonucleotide
gtctatgctgcagtcatatt

SEQ ID NO: 4120 - DNA, 20 bp, Artificial sequence
  Synthetic oligonucleotide
ggtctatgctgcagtcatat

SEQ ID NO: 4121 - DNA, 20 bp, Artificial sequence
  Synthetic oligonucleotide
aggtctatgctgcagtcata

SEQ ID NO: 4122 - DNA, 20 bp, Artificial sequence
  Synthetic oligonucleotide
acaggtctatgctgcagtca

SEQ ID NO: 4123 - DNA, 20 bp, Artificial sequence
  Synthetic oligonucleotide
gacaggtctatgctgcagtc

SEQ ID NO: 4124 - DNA, 20 bp, Artificial sequence
  Synthetic oligonucleotide
tgacaggtctatgctgcagt

SEQ ID NO: 4125 - DNA, 20 bp, Artificial sequence
  Synthetic oligonucleotide
ctgacaggtctatgctgcag

SEQ ID NO: 4126 - DNA, 20 bp, Artificial sequence
  Synthetic oligonucleotide
cactcttctgacaggtctat

SEQ ID NO: 4127 - DNA, 20 bp, Artificial sequence
  Synthetic oligonucleotide
ccactcttctgacaggtcta

SEQ ID NO: 4128 - DNA, 20 bp, Artificial sequence
  Synthetic oligonucleotide
tccactcttctgacaggtct

SEQ ID NO: 4129 - DNA, 20 bp, Artificial sequence
  Synthetic oligonucleotide
ttccactcttctgacaggtc

SEQ ID NO: 4130 - DNA, 20 bp, Artificial sequence
  Synthetic oligonucleotide
ttttccactcttctgacagg

SEQ ID NO: 4131 - DNA, 20 bp, Artificial sequence
  Synthetic oligonucleotide
gttttccactcttctgacag

SEQ ID NO: 4132 - DNA, 20 bp, Artificial sequence
  Synthetic oligonucleotide
tgttttccactcttctgaca

SEQ ID NO: 4133 - DNA, 20 bp, Artificial sequence
  Synthetic oligonucleotide
atctcttccatctccactgc

SEQ ID NO: 4134 - DNA, 20 bp, Artificial sequence
  Synthetic oligonucleotide
catctcttccatctccactg

SEQ ID NO: 4135 - DNA, 20 bp, Artificial sequence
  Synthetic oligonucleotide
acatctcttccatctccact

SEQ ID NO: 4136 - DNA, 20 bp, Artificial sequence
  Synthetic oligonucleotide
cacatctcttccatctccac

SEQ ID NO: 4137 - DNA, 20 bp, Artificial sequence
  Synthetic oligonucleotide
tgcacatctcttccatctcc

SEQ ID NO: 4138 - DNA, 20 bp, Artificial sequence
  Synthetic oligonucleotide
atgcacatctcttccatctc

SEQ ID NO: 4139 - DNA, 20 bp, Artificial sequence
  Synthetic oligonucleotide
catgcacatctcttccatct

SEQ ID NO: 4140 - DNA, 20 bp, Artificial sequence
  Synthetic oligonucleotide
tcatgcacatctcttccatc

SEQ ID NO: 4141 - DNA, 17 bp, Artificial sequence
  Synthetic oligonucleotide
ccacagggccctttcca

SEQ ID NO: 4142 - DNA, 17 bp, Artificial sequence
  Synthetic oligonucleotide
gccacagggccctttcc

SEQ ID NO: 4143 - DNA, 17 bp, Artificial sequence
  Synthetic oligonucleotide
gttctcgaatatcccta

SEQ ID NO: 4144 - DNA, 17 bp, Artificial sequence
  Synthetic oligonucleotide
agttctcgaatatccct

SEQ ID NO: 4145 - DNA, 17 bp, Artificial sequence
  Synthetic oligonucleotide
gagttctcgaatatccc

SEQ ID NO: 4146 - DNA, 17 bp, Artificial sequence
  Synthetic oligonucleotide
ggagttctcgaatatcc

SEQ ID NO: 4147 - DNA, 17 bp, Artificial sequence
  Synthetic oligonucleotide
aggagttctcgaatatc

SEQ ID NO: 4148 - DNA, 17 bp, Artificial sequence
  Synthetic oligonucleotide
gaggagttctcgaatat

SEQ ID NO: 4149 - DNA, 17 bp, Artificial sequence
  Synthetic oligonucleotide
ggtcctctccgctgcct

SEQ ID NO: 4150 - DNA, 17 bp, Artificial sequence
  Synthetic oligonucleotide
gggtcctctccgctgcc

SEQ ID NO: 4151 - DNA, 17 bp, Artificial sequence
  Synthetic oligonucleotide
agggtcctctccgctgc

SEQ ID NO: 4152 - DNA, 17 bp, Artificial sequence
  Synthetic oligonucleotide
ttcactgaggacctcag

SEQ ID NO: 4153 - DNA, 17 bp, Artificial sequence
  Synthetic oligonucleotide
attcactgaggacctca

SEQ ID NO: 4154 - DNA, 17 bp, Artificial sequence
  Synthetic oligonucleotide
gattcactgaggacctc

SEQ ID NO: 4155 - DNA, 17 bp, Artificial sequence
  Synthetic oligonucleotide
cgattcactgaggacct

SEQ ID NO: 4156 - DNA, 17 bp, Artificial sequence
  Synthetic oligonucleotide
gcgattcactgaggacc

SEQ ID NO: 4157 - DNA, 17 bp, Artificial sequence
  Synthetic oligonucleotide
cgcgattcactgaggac

SEQ ID NO: 4158 - DNA, 17 bp, Artificial sequence
  Synthetic oligonucleotide
gcgcgattcactgagga

SEQ ID NO: 4159 - DNA, 17 bp, Artificial sequence
  Synthetic oligonucleotide
tgcgcgattcactgagg

SEQ ID NO: 4160 - DNA, 17 bp, Artificial sequence
  Synthetic oligonucleotide
ctgcgcgattcactgag

SEQ ID NO: 4161 - DNA, 17 bp, Artificial sequence
  Synthetic oligonucleotide
tctgcgcgattcactga

SEQ ID NO: 4162 - DNA, 17 bp, Artificial sequence
  Synthetic oligonucleotide
tcctcccacttcagttt

SEQ ID NO: 4163 - DNA, 17 bp, Artificial sequence
  Synthetic oligonucleotide
ttcctcccacttcagtt

SEQ ID NO: 4164 - DNA, 17 bp, Artificial sequence
  Synthetic oligonucleotide
cttcctcccacttcagt

SEQ ID NO: 4165 - DNA, 17 bp, Artificial sequence
  Synthetic oligonucleotide
tgcttcctcccacttca

SEQ ID NO: 4166 - DNA, 17 bp, Artificial sequence
  Synthetic oligonucleotide
atgcttcctcccacttc

SEQ ID NO: 4167 - DNA, 17 bp, Artificial sequence
  Synthetic oligonucleotide
catgcttcctcccactt

SEQ ID NO: 4168 - DNA, 17 bp, Artificial sequence
  Synthetic oligonucleotide
gcatgcttcctcccact

SEQ ID NO: 4169 - DNA, 17 bp, Artificial sequence
  Synthetic oligonucleotide
ggcatgcttcctcccac

SEQ ID NO: 4170 - DNA, 17 bp, Artificial sequence
  Synthetic oligonucleotide
aggcatgcttcctccca

SEQ ID NO: 4171 - DNA, 17 bp, Artificial sequence
  Synthetic oligonucleotide
taggcatgcttcctccc

SEQ ID NO: 4172 - DNA, 17 bp, Artificial sequence
  Synthetic oligonucleotide
ttaggcatgcttcctcc

SEQ ID NO: 4173 - DNA, 17 bp, Artificial sequence
  Synthetic oligonucleotide
cttaggcatgcttcctc

SEQ ID NO: 4174 - DNA, 17 bp, Artificial sequence
  Synthetic oligonucleotide
acttaggcatgcttcct

SEQ ID NO: 4175 - DNA, 17 bp, Artificial sequence
  Synthetic oligonucleotide
aacttaggcatgcttcc

SEQ ID NO: 4176 - DNA, 17 bp, Artificial sequence
  Synthetic oligonucleotide
aaacttaggcatgcttc

SEQ ID NO: 4177 - DNA, 17 bp, Artificial sequence
  Synthetic oligonucleotide
aaaacttaggcatgctt

SEQ ID NO: 4178 - DNA, 17 bp, Artificial sequence
  Synthetic oligonucleotide
gaaaacttaggcatgct

SEQ ID NO: 4179 - DNA, 17 bp, Artificial sequence
  Synthetic oligonucleotide
ggaaaacttaggcatgc

SEQ ID NO: 4180 - DNA, 17 bp, Artificial sequence
  Synthetic oligonucleotide
aggaaaacttaggcatg

SEQ ID NO: 4181 - DNA, 17 bp, Artificial sequence
  Synthetic oligonucleotide
aaggaaaacttaggcat

SEQ ID NO: 4182 - DNA, 17 bp, Artificial sequence
  Synthetic oligonucleotide
taaggaaaacttaggca

SEQ ID NO: 4183 - DNA, 17 bp, Artificial sequence
  Synthetic oligonucleotide
ctaaggaaaacttaggc

SEQ ID NO: 4184 - DNA, 17 bp, Artificial sequence
  Synthetic oligonucleotide
gatgacttcccagggtc

SEQ ID NO: 4185 - DNA, 17 bp, Artificial sequence
  Synthetic oligonucleotide
tgatgacttcccagggt

SEQ ID NO: 4186 - DNA, 17 bp, Artificial sequence
  Synthetic oligonucleotide
gtgatgacttcccaggg

SEQ ID NO: 4187 - DNA, 17 bp, Artificial sequence
  Synthetic oligonucleotide
tgtgatgacttcccagg

SEQ ID NO: 4188 - DNA, 17 bp, Artificial sequence
  Synthetic oligonucleotide
ctgtgatgacttcccag

SEQ ID NO: 4189 - DNA, 17 bp, Artificial sequence
  Synthetic oligonucleotide
gctgtgatgacttccca

SEQ ID NO: 4190 - DNA, 17 bp, Artificial sequence
  Synthetic oligonucleotide
agctgtgatgacttccc

SEQ ID NO: 4191 - DNA, 17 bp, Artificial sequence
  Synthetic oligonucleotide
cagctgtgatgacttcc

SEQ ID NO: 4192 - DNA, 17 bp, Artificial sequence
  Synthetic oligonucleotide
acagctgtgatgacttc

SEQ ID NO: 4193 - DNA, 17 bp, Artificial sequence
  Synthetic oligonucleotide
gacagctgtgatgactt

SEQ ID NO: 4194 - DNA, 17 bp, Artificial sequence
  Synthetic oligonucleotide
tgtcagagaggctcagc

SEQ ID NO: 4195 - DNA, 17 bp, Artificial sequence
  Synthetic oligonucleotide
atgtcagagaggctcag

SEQ ID NO: 4196 - DNA, 17 bp, Artificial sequence
  Synthetic oligonucleotide
catgtcagagaggctca

SEQ ID NO: 4197 - DNA, 17 bp, Artificial sequence
  Synthetic oligonucleotide
ccatgtcagagaggctc

SEQ ID NO: 4198 - DNA, 17 bp, Artificial sequence
  Synthetic oligonucleotide
tccatgtcagagaggct

SEQ ID NO: 4199 - DNA, 17 bp, Artificial sequence
  Synthetic oligonucleotide
atccatgtcagagaggc

SEQ ID NO: 4200 - DNA, 17 bp, Artificial sequence
  Synthetic oligonucleotide
aatccatgtcagagagg

SEQ ID NO: 4201 - DNA, 17 bp, Artificial sequence
  Synthetic oligonucleotide
aaatccatgtcagagag

SEQ ID NO: 4202 - DNA, 17 bp, Artificial sequence
  Synthetic oligonucleotide
tagtcgatttaccagaa

SEQ ID NO: 4203 - DNA, 17 bp, Artificial sequence
  Synthetic oligonucleotide
atagtcgatttaccaga

SEQ ID NO: 4204 - DNA, 17 bp, Artificial sequence
  Synthetic oligonucleotide
gatagtcgatttaccag

SEQ ID NO: 4205 - DNA, 17 bp, Artificial sequence
  Synthetic oligonucleotide
ggatagtcgatttacca

SEQ ID NO: 4206 - DNA, 17 bp, Artificial sequence
  Synthetic oligonucleotide
tggatagtcgatttacc

SEQ ID NO: 4207 - DNA, 17 bp, Artificial sequence
  Synthetic oligonucleotide
ttggatagtcgatttac

SEQ ID NO: 4208 - DNA, 17 bp, Artificial sequence
  Synthetic oligonucleotide
tttggatagtcgattta

SEQ ID NO: 4209 - DNA, 17 bp, Artificial sequence
  Synthetic oligonucleotide
cgatgttacattaaggg

SEQ ID NO: 4210 - DNA, 17 bp, Artificial sequence
  Synthetic oligonucleotide
tcgatgttacattaagg

SEQ ID NO: 4211 - DNA, 17 bp, Artificial sequence
  Synthetic oligonucleotide
ctcgatgttacattaag

SEQ ID NO: 4212 - DNA, 17 bp, Artificial sequence
  Synthetic oligonucleotide
attattctaaaactcaa

SEQ ID NO: 4213 - DNA, 17 bp, Artificial sequence
  Synthetic oligonucleotide
gattattctaaaactca

SEQ ID NO: 4214 - DNA, 17 bp, Artificial sequence
  Synthetic oligonucleotide
tgattattctaaaactc

SEQ ID NO: 4215 - DNA, 17 bp, Artificial sequence
  Synthetic oligonucleotide
gggcagtcaccatttgc

SEQ ID NO: 4216 - DNA, 17 bp, Artificial sequence
  Synthetic oligonucleotide
tgggcagtcaccatttg

SEQ ID NO: 4217 - DNA, 17 bp, Artificial sequence
  Synthetic oligonucleotide
ttgggcagtcaccattt

SEQ ID NO: 4218 - DNA, 17 bp, Artificial sequence
  Synthetic oligonucleotide
cctcgatgttacattaa

SEQ ID NO: 4219 - DNA, 17 bp, Artificial sequence
  Synthetic oligonucleotide
tattgcaaccactagga

SEQ ID NO: 4220 - DNA, 17 bp, Artificial sequence
  Synthetic oligonucleotide
ttattgcaaccactagg

SEQ ID NO: 4221 - DNA, 17 bp, Artificial sequence
  Synthetic oligonucleotide
gttattgcaaccactag

SEQ ID NO: 4222 - DNA, 17 bp, Artificial sequence
  Synthetic oligonucleotide
ggttattgcaaccacta

SEQ ID NO: 4223 - DNA, 17 bp, Artificial sequence
  Synthetic oligonucleotide
agttaaagtgtggtaca

SEQ ID NO: 4224 - DNA, 17 bp, Artificial sequence
  Synthetic oligonucleotide
cagttaaagtgtggtac

SEQ ID NO: 4225 - DNA, 17 bp, Artificial sequence
  Synthetic oligonucleotide
acagttaaagtgtggta

SEQ ID NO: 4226 - DNA, 17 bp, Artificial sequence
  Synthetic oligonucleotide
atgcctaggtcacagtt

SEQ ID NO: 4227 - DNA, 17 bp, Artificial sequence
  Synthetic oligonucleotide
aatgcctaggtcacagt

SEQ ID NO: 4228 - DNA, 17 bp, Artificial sequence
  Synthetic oligonucleotide
caatgcctaggtcacag

SEQ ID NO: 4229 - DNA, 17 bp, Artificial sequence
  Synthetic oligonucleotide
ccaatgcctaggtcaca

SEQ ID NO: 4230 - DNA, 17 bp, Artificial sequence
  Synthetic oligonucleotide
gccaatgcctaggtcac

SEQ ID NO: 4231 - DNA, 17 bp, Artificial sequence
  Synthetic oligonucleotide
tgccaatgcctaggtca

SEQ ID NO: 4232 - DNA, 17 bp, Artificial sequence
  Synthetic oligonucleotide
atgccaatgcctaggtc

SEQ ID NO: 4233 - DNA, 17 bp, Artificial sequence
  Synthetic oligonucleotide
aatgccaatgcctaggt

SEQ ID NO: 4234 - DNA, 17 bp, Artificial sequence
  Synthetic oligonucleotide
caatgccaatgcctagg

SEQ ID NO: 4235 - DNA, 17 bp, Artificial sequence
  Synthetic oligonucleotide
gcaatgccaatgcctag

SEQ ID NO: 4236 - DNA, 17 bp, Artificial sequence
  Synthetic oligonucleotide
agcgataatcacacaag

SEQ ID NO: 4237 - DNA, 17 bp, Artificial sequence
  Synthetic oligonucleotide
cagcgataatcacacaa

SEQ ID NO: 4238 - DNA, 17 bp, Artificial sequence
  Synthetic oligonucleotide
acagcgataatcacaca

SEQ ID NO: 4239 - DNA, 17 bp, Artificial sequence
  Synthetic oligonucleotide
cacagcgataatcacac

SEQ ID NO: 4240 - DNA, 17 bp, Artificial sequence
  Synthetic oligonucleotide
ccacagcgataatcaca

SEQ ID NO: 4241 - DNA, 17 bp, Artificial sequence
  Synthetic oligonucleotide
accacagcgataatcac

SEQ ID NO: 4242 - DNA, 17 bp, Artificial sequence
  Synthetic oligonucleotide
aaccacagcgataatca

SEQ ID NO: 4243 - DNA, 17 bp, Artificial sequence
  Synthetic oligonucleotide
ggtctgccactctctac

SEQ ID NO: 4244 - DNA, 17 bp, Artificial sequence
  Synthetic oligonucleotide
gggtctgccactctcta

SEQ ID NO: 4245 - DNA, 17 bp, Artificial sequence
  Synthetic oligonucleotide
agggtctgccactctct

SEQ ID NO: 4246 - DNA, 17 bp, Artificial sequence
  Synthetic oligonucleotide
agtcatcttgtgtacat

SEQ ID NO: 4247 - DNA, 17 bp, Artificial sequence
  Synthetic oligonucleotide
cagtcatcttgtgtaca

SEQ ID NO: 4248 - DNA, 17 bp, Artificial sequence
  Synthetic oligonucleotide
acagtcatcttgtgtac

SEQ ID NO: 4249 - DNA, 17 bp, Artificial sequence
  Synthetic oligonucleotide
cagatcactctgcacag

SEQ ID NO: 4250 - DNA, 17 bp, Artificial sequence
  Synthetic oligonucleotide
tcagatcactctgcaca

SEQ ID NO: 4251 - DNA, 17 bp, Artificial sequence
  Synthetic oligonucleotide
ctcagatcactctgcac

SEQ ID NO: 4252 - DNA, 17 bp, Artificial sequence
  Synthetic oligonucleotide
tgctcagatcactctgc

SEQ ID NO: 4253 - DNA, 17 bp, Artificial sequence
  Synthetic oligonucleotide
ttgctcagatcactctg

SEQ ID NO: 4254 - DNA, 17 bp, Artificial sequence
  Synthetic oligonucleotide
attgctcagatcactct

SEQ ID NO: 4255 - DNA, 17 bp, Artificial sequence
  Synthetic oligonucleotide
acctcttccaggaagac

SEQ ID NO: 4256 - DNA, 17 bp, Artificial sequence
  Synthetic oligonucleotide
cacctcttccaggaaga

SEQ ID NO: 4257 - DNA, 17 bp, Artificial sequence
  Synthetic oligonucleotide
tcacctcttccaggaag

SEQ ID NO: 4258 - DNA, 17 bp, Artificial sequence
  Synthetic oligonucleotide
actgaatgtcacctctt

SEQ ID NO: 4259 - DNA, 17 bp, Artificial sequence
  Synthetic oligonucleotide
gactgaatgtcacctct

SEQ ID NO: 4260 - DNA, 17 bp, Artificial sequence
  Synthetic oligonucleotide
ggactgaatgtcacctc

SEQ ID NO: 4261 - DNA, 17 bp, Artificial sequence
  Synthetic oligonucleotide
cggactgaatgtcacct

SEQ ID NO: 4262 - DNA, 17 bp, Artificial sequence
  Synthetic oligonucleotide
ccggactgaatgtcacc

SEQ ID NO: 4263 - DNA, 17 bp, Artificial sequence
  Synthetic oligonucleotide
tccggactgaatgtcac

SEQ ID NO: 4264 - DNA, 17 bp, Artificial sequence
  Synthetic oligonucleotide
tctttccagatccggac

SEQ ID NO: 4265 - DNA, 17 bp, Artificial sequence
  Synthetic oligonucleotide
atctttccagatccgga

SEQ ID NO: 4266 - DNA, 17 bp, Artificial sequence
  Synthetic oligonucleotide
catctttccagatccgg

SEQ ID NO: 4267 - DNA, 17 bp, Artificial sequence
  Synthetic oligonucleotide
tcatctttccagatccg

SEQ ID NO: 4268 - DNA, 17 bp, Artificial sequence
  Synthetic oligonucleotide
ttcatctttccagatcc

SEQ ID NO: 4269 - DNA, 17 bp, Artificial sequence
  Synthetic oligonucleotide
attcatctttccagatc

SEQ ID NO: 4270 - DNA, 17 bp, Artificial sequence
  Synthetic oligonucleotide
tctcaagtcttcctcct

SEQ ID NO: 4271 - DNA, 17 bp, Artificial sequence
  Synthetic oligonucleotide
ctctcaagtcttcctcc

SEQ ID NO: 4272 - DNA, 17 bp, Artificial sequence
  Synthetic oligonucleotide
gctctcaagtcttcctc

SEQ ID NO: 4273 - DNA, 17 bp, Artificial sequence
  Synthetic oligonucleotide
agctctcaagtcttcct

SEQ ID NO: 4274 - DNA, 17 bp, Artificial sequence
  Synthetic oligonucleotide
gagctctcaagtcttcc

SEQ ID NO: 4275 - DNA, 17 bp, Artificial sequence
  Synthetic oligonucleotide
tgagctctcaagtcttc

SEQ ID NO: 4276 - DNA, 17 bp, Artificial sequence
  Synthetic oligonucleotide
ataatctgcacaggttc

SEQ ID NO: 4277 - DNA, 17 bp, Artificial sequence
  Synthetic oligonucleotide
cataatctgcacaggtt

SEQ ID NO: 4278 - DNA, 17 bp, Artificial sequence
  Synthetic oligonucleotide
ccataatctgcacaggt

SEQ ID NO: 4279 - DNA, 17 bp, Artificial sequence
  Synthetic oligonucleotide
accataatctgcacagg

SEQ ID NO: 4280 - DNA, 17 bp, Artificial sequence
  Synthetic oligonucleotide
caccataatctgcacag

SEQ ID NO: 4281 - DNA, 17 bp, Artificial sequence
  Synthetic oligonucleotide
gcaccataatctgcaca

SEQ ID NO: 4282 - DNA, 17 bp, Artificial sequence
  Synthetic oligonucleotide
ttaatccaggattgtca

SEQ ID NO: 4283 - DNA, 17 bp, Artificial sequence
  Synthetic oligonucleotide
tttaatccaggattgtc

SEQ ID NO: 4284 - DNA, 17 bp, Artificial sequence
  Synthetic oligonucleotide
ctttaatccaggattgt

SEQ ID NO: 4285 - DNA, 17 bp, Artificial sequence
  Synthetic oligonucleotide
tagctttaatccaggat

SEQ ID NO: 4286 - DNA, 17 bp, Artificial sequence
  Synthetic oligonucleotide
ttagctttaatccagga

SEQ ID NO: 4287 - DNA, 17 bp, Artificial sequence
  Synthetic oligonucleotide
cttagctttaatccagg

SEQ ID NO: 4288 - DNA, 17 bp, Artificial sequence
  Synthetic oligonucleotide
ccttagctttaatccag

SEQ ID NO: 4289 - DNA, 17 bp, Artificial sequence
  Synthetic oligonucleotide
tccttagctttaatcca

SEQ ID NO: 4290 - DNA, 17 bp, Artificial sequence
  Synthetic oligonucleotide
ctccttagctttaatcc

SEQ ID NO: 4291 - DNA, 17 bp, Artificial sequence
  Synthetic oligonucleotide
cctccttagctttaatc

SEQ ID NO: 4292 - DNA, 17 bp, Artificial sequence
  Synthetic oligonucleotide
tcctccttagctttaat

SEQ ID NO: 4293 - DNA, 17 bp, Artificial sequence
  Synthetic oligonucleotide
tcagtgtcctccttagc

SEQ ID NO: 4294 - DNA, 17 bp, Artificial sequence
  Synthetic oligonucleotide
ctcagtgtcctccttag

SEQ ID NO: 4295 - DNA, 17 bp, Artificial sequence
  Synthetic oligonucleotide
actcagtgtcctcctta

SEQ ID NO: 4296 - DNA, 17 bp, Artificial sequence
  Synthetic oligonucleotide
gactcagtgtcctcctt

SEQ ID NO: 4297 - DNA, 17 bp, Artificial sequence
  Synthetic oligonucleotide
ggactcagtgtcctcct

SEQ ID NO: 4298 - DNA, 17 bp, Artificial sequence
  Synthetic oligonucleotide
tgggactcagtgtcctc

SEQ ID NO: 4299 - DNA, 17 bp, Artificial sequence
  Synthetic oligonucleotide
ctgggactcagtgtcct

SEQ ID NO: 4300 - DNA, 17 bp, Artificial sequence
  Synthetic oligonucleotide
cctgggactcagtgtcc

SEQ ID NO: 4301 - DNA, 17 bp, Artificial sequence
  Synthetic oligonucleotide
ctgtttgatgggtaaaa

SEQ ID NO: 4302 - DNA, 17 bp, Artificial sequence
  Synthetic oligonucleotide
cctgtttgatgggtaaa

SEQ ID NO: 4303 - DNA, 17 bp, Artificial sequence
  Synthetic oligonucleotide
tcctgtttgatgggtaa

SEQ ID NO: 4304 - DNA, 17 bp, Artificial sequence
  Synthetic oligonucleotide
ctcctgtttgatgggta

SEQ ID NO: 4305 - DNA, 17 bp, Artificial sequence
  Synthetic oligonucleotide
tctcctgtttgatgggt

SEQ ID NO: 4306 - DNA, 17 bp, Artificial sequence
  Synthetic oligonucleotide
ctctcctgtttgatggg

SEQ ID NO: 4307 - DNA, 17 bp, Artificial sequence
  Synthetic oligonucleotide
cctctcctgtttgatgg

SEQ ID NO: 4308 - DNA, 17 bp, Artificial sequence
  Synthetic oligonucleotide
tcggtgtcctctcctgt

SEQ ID NO: 4309 - DNA, 17 bp, Artificial sequence
  Synthetic oligonucleotide
ctcggtgtcctctcctg

SEQ ID NO: 4310 - DNA, 17 bp, Artificial sequence
  Synthetic oligonucleotide
cctcggtgtcctctcct

SEQ ID NO: 4311 - DNA, 17 bp, Artificial sequence
  Synthetic oligonucleotide
gcctcggtgtcctctcc

SEQ ID NO: 4312 - DNA, 17 bp, Artificial sequence
  Synthetic oligonucleotide
agcctcggtgtcctctc

SEQ ID NO: 4313 - DNA, 17 bp, Artificial sequence
  Synthetic oligonucleotide
aagcctcggtgtcctct

SEQ ID NO: 4314 - DNA, 17 bp, Artificial sequence
  Synthetic oligonucleotide
taagcctcggtgtcctc

SEQ ID NO: 4315 - DNA, 17 bp, Artificial sequence
  Synthetic oligonucleotide
gtaagcctcggtgtcct

SEQ ID NO: 4316 - DNA, 17 bp, Artificial sequence
  Synthetic oligonucleotide
agtaagcctcggtgtcc

SEQ ID NO: 4317 - DNA, 17 bp, Artificial sequence
  Synthetic oligonucleotide
ccagattgttgtgggaa

SEQ ID NO: 4318 - DNA, 17 bp, Artificial sequence
  Synthetic oligonucleotide
accagattgttgtggga

SEQ ID NO: 4319 - DNA, 17 bp, Artificial sequence
  Synthetic oligonucleotide
caccagattgttgtggg

SEQ ID NO: 4320 - DNA, 17 bp, Artificial sequence
  Synthetic oligonucleotide
ctaatacctacctcacc

SEQ ID NO: 4321 - DNA, 17 bp, Artificial sequence
  Synthetic oligonucleotide
gctaatacctacctcac

SEQ ID NO: 4322 - DNA, 17 bp, Artificial sequence
  Synthetic oligonucleotide
ggctaatacctacctca

SEQ ID NO: 4323 - DNA, 17 bp, Artificial sequence
  Synthetic oligonucleotide
ctcatctatacagtggg

SEQ ID NO: 4324 - DNA, 17 bp, Artificial sequence
  Synthetic oligonucleotide
cctcatctatacagtgg

SEQ ID NO: 4325 - DNA, 17 bp, Artificial sequence
  Synthetic oligonucleotide
tcctcatctatacagtg

SEQ ID NO: 4326 - DNA, 17 bp, Artificial sequence
  Synthetic oligonucleotide
actggcatctggcaggg

SEQ ID NO: 4327 - DNA, 17 bp, Artificial sequence
  Synthetic oligonucleotide
tactggcatctggcagg

SEQ ID NO: 4328 - DNA, 17 bp, Artificial sequence
  Synthetic oligonucleotide
atactggcatctggcag

SEQ ID NO: 4329 - DNA, 17 bp, Artificial sequence
  Synthetic oligonucleotide
tcacctccatactggca

SEQ ID NO: 4330 - DNA, 17 bp, Artificial sequence
  Synthetic oligonucleotide
ctcacctccatactggc

SEQ ID NO: 4331 - DNA, 17 bp, Artificial sequence
  Synthetic oligonucleotide
cctcacctccatactgg

SEQ ID NO: 4332 - DNA, 17 bp, Artificial sequence
  Synthetic oligonucleotide
atgcttaacttctgctg

SEQ ID NO: 4333 - DNA, 17 bp, Artificial sequence
  Synthetic oligonucleotide
gatgcttaacttctgct

SEQ ID NO: 4334 - DNA, 17 bp, Artificial sequence
  Synthetic oligonucleotide
ggatgcttaacttctgc

SEQ ID NO: 4335 - DNA, 17 bp, Artificial sequence
  Synthetic oligonucleotide
aggatgcttaacttctg

SEQ ID NO: 4336 - DNA, 17 bp, Artificial sequence
  Synthetic oligonucleotide
taggatgcttaacttct

SEQ ID NO: 4337 - DNA, 17 bp, Artificial sequence
  Synthetic oligonucleotide
ttaggatgcttaacttc

SEQ ID NO: 4338 - DNA, 17 bp, Artificial sequence
  Synthetic oligonucleotide
ggcctggatgcccaagt

SEQ ID NO: 4339 - DNA, 17 bp, Artificial sequence
  Synthetic oligonucleotide
aggcctggatgcccaag

SEQ ID NO: 4340 - DNA, 17 bp, Artificial sequence
  Synthetic oligonucleotide
taggcctggatgcccaa

SEQ ID NO: 4341 - DNA, 17 bp, Artificial sequence
  Synthetic oligonucleotide
cagatgatgtcctgcct

SEQ ID NO: 4342 - DNA, 17 bp, Artificial sequence
  Synthetic oligonucleotide
gcagatgatgtcctgcc

SEQ ID NO: 4343 - DNA, 17 bp, Artificial sequence
  Synthetic oligonucleotide
agcagatgatgtcctgc

SEQ ID NO: 4344 - DNA, 17 bp, Artificial sequence
  Synthetic oligonucleotide
tagtcaaaggtggcttc

SEQ ID NO: 4345 - DNA, 17 bp, Artificial sequence
  Synthetic oligonucleotide
gtagtcaaaggtggctt

SEQ ID NO: 4346 - DNA, 17 bp, Artificial sequence
  Synthetic oligonucleotide
agtagtcaaaggtggct

SEQ ID NO: 4347 - DNA, 17 bp, Artificial sequence
  Synthetic oligonucleotide
aacaagtgggaaatgca

SEQ ID NO: 4348 - DNA, 17 bp, Artificial sequence
  Synthetic oligonucleotide
caacaagtgggaaatgc

SEQ ID NO: 4349 - DNA, 17 bp, Artificial sequence
  Synthetic oligonucleotide
ccaacaagtgggaaatg

SEQ ID NO: 4350 - DNA, 17 bp, Artificial sequence
  Synthetic oligonucleotide
agcttattaggtgtctt

SEQ ID NO: 4351 - DNA, 17 bp, Artificial sequence
  Synthetic oligonucleotide
aagcttattaggtgtct

SEQ ID NO: 4352 - DNA, 17 bp, Artificial sequence
  Synthetic oligonucleotide
taagcttattaggtgtc

SEQ ID NO: 4353 - DNA, 17 bp, Artificial sequence
  Synthetic oligonucleotide
ctaagcttattaggtgt

SEQ ID NO: 4354 - DNA, 17 bp, Artificial sequence
  Synthetic oligonucleotide
cccccatgcagcttgga

SEQ ID NO: 4355 - DNA, 17 bp, Artificial sequence
  Synthetic oligonucleotide
gcccccatgcagcttgg

SEQ ID NO: 4356 - DNA, 17 bp, Artificial sequence
  Synthetic oligonucleotide
agcccccatgcagcttg

SEQ ID NO: 4357 - DNA, 17 bp, Artificial sequence
  Synthetic oligonucleotide
ccaaacactcaggtagg

SEQ ID NO: 4358 - DNA, 17 bp, Artificial sequence
  Synthetic oligonucleotide
tccaaacactcaggtag

SEQ ID NO: 4359 - DNA, 17 bp, Artificial sequence
  Synthetic oligonucleotide
gtccaaacactcaggta

SEQ ID NO: 4360 - DNA, 17 bp, Artificial sequence
  Synthetic oligonucleotide
cagtccaaacactcagg

SEQ ID NO: 4361 - DNA, 17 bp, Artificial sequence
  Synthetic oligonucleotide
tcagtccaaacactcag

SEQ ID NO: 4362 - DNA, 17 bp, Artificial sequence
  Synthetic oligonucleotide
ttcagtccaaacactca

SEQ ID NO: 4363 - DNA, 17 bp, Artificial sequence
  Synthetic oligonucleotide
gaacagcagcatcagca

SEQ ID NO: 4364 - DNA, 17 bp, Artificial sequence
  Synthetic oligonucleotide
ggaacagcagcatcagc

SEQ ID NO: 4365 - DNA, 17 bp, Artificial sequence
  Synthetic oligonucleotide
gggaacagcagcatcag

SEQ ID NO: 4366 - DNA, 17 bp, Artificial sequence
  Synthetic oligonucleotide
tgggaacagcagcatca

SEQ ID NO: 4367 - DNA, 17 bp, Artificial sequence
  Synthetic oligonucleotide
ctgggaacagcagcatc

SEQ ID NO: 4368 - DNA, 17 bp, Artificial sequence
  Synthetic oligonucleotide
tctgggaacagcagcat

SEQ ID NO: 4369 - DNA, 17 bp, Artificial sequence
  Synthetic oligonucleotide
tctaaaactcaaatcca

SEQ ID NO: 4370 - DNA, 17 bp, Artificial sequence
  Synthetic oligonucleotide
ttctaaaactcaaatcc

SEQ ID NO: 4371 - DNA, 17 bp, Artificial sequence
  Synthetic oligonucleotide
attctaaaactcaaatc

SEQ ID NO: 4372 - DNA, 17 bp, Artificial sequence
  Synthetic oligonucleotide
gtctgggaacagcagca

SEQ ID NO: 4373 - DNA, 17 bp, Artificial sequence
  Synthetic oligonucleotide
ggtctgggaacagcagc

SEQ ID NO: 4374 - DNA, 17 bp, Artificial sequence
  Synthetic oligonucleotide
tggtctgggaacagcag

SEQ ID NO: 4375 - DNA, 17 bp, Artificial sequence
  Synthetic oligonucleotide
acaagtcatcttccagc

SEQ ID NO: 4376 - DNA, 17 bp, Artificial sequence
  Synthetic oligonucleotide
gacaagtcatcttccag

SEQ ID NO: 4377 - DNA, 17 bp, Artificial sequence
  Synthetic oligonucleotide
ggacaagtcatcttcca

SEQ ID NO: 4378 - DNA, 17 bp, Artificial sequence
  Synthetic oligonucleotide
atccttgagggtctcat

SEQ ID NO: 4379 - DNA, 17 bp, Artificial sequence
  Synthetic oligonucleotide
tatccttgagggtctca

SEQ ID NO: 4380 - DNA, 17 bp, Artificial sequence
  Synthetic oligonucleotide
ttatccttgagggtctc

SEQ ID NO: 4381 - DNA, 17 bp, Artificial sequence
  Synthetic oligonucleotide
cttatccttgagggtct

SEQ ID NO: 4382 - DNA, 17 bp, Artificial sequence
  Synthetic oligonucleotide
cctggatggcaacctaa

SEQ ID NO: 4383 - DNA, 17 bp, Artificial sequence
  Synthetic oligonucleotide
gcctggatggcaaccta

SEQ ID NO: 4384 - DNA, 17 bp, Artificial sequence
  Synthetic oligonucleotide
ggcctggatggcaacct

SEQ ID NO: 4385 - DNA, 17 bp, Artificial sequence
  Synthetic oligonucleotide
ctgctatgctgagagca

SEQ ID NO: 4386 - DNA, 17 bp, Artificial sequence
  Synthetic oligonucleotide
cctgctatgctgagagc

SEQ ID NO: 4387 - DNA, 17 bp, Artificial sequence
  Synthetic oligonucleotide
acctgctatgctgagag

SEQ ID NO: 4388 - DNA, 17 bp, Artificial sequence
  Synthetic oligonucleotide
gttcatctgccttgacg

SEQ ID NO: 4389 - DNA, 17 bp, Artificial sequence
  Synthetic oligonucleotide
ggttcatctgccttgac

SEQ ID NO: 4390 - DNA, 17 bp, Artificial sequence
  Synthetic oligonucleotide
aggttcatctgccttga

SEQ ID NO: 4391 - DNA, 17 bp, Artificial sequence
  Synthetic oligonucleotide
caggttcatctgccttg

SEQ ID NO: 4392 - DNA, 17 bp, Artificial sequence
  Synthetic oligonucleotide
gcaggttcatctgcctt

SEQ ID NO: 4393 - DNA, 17 bp, Artificial sequence
  Synthetic oligonucleotide
agcaggttcatctgcct

SEQ ID NO: 4394 - DNA, 17 bp, Artificial sequence
  Synthetic oligonucleotide
tctgtgatgctctggag

SEQ ID NO: 4395 - DNA, 17 bp, Artificial sequence
  Synthetic oligonucleotide
ctctgtgatgctctgga

SEQ ID NO: 4396 - DNA, 17 bp, Artificial sequence
  Synthetic oligonucleotide
actctgtgatgctctgg

SEQ ID NO: 4397 - DNA, 17 bp, Artificial sequence
  Synthetic oligonucleotide
cactctgtgatgctctg

SEQ ID NO: 4398 - DNA, 17 bp, Artificial sequence
  Synthetic oligonucleotide
acatggtaagtcctgat

SEQ ID NO: 4399 - DNA, 17 bp, Artificial sequence
  Synthetic oligonucleotide
gacatggtaagtcctga

SEQ ID NO: 4400 - DNA, 17 bp, Artificial sequence
  Synthetic oligonucleotide
tgacatggtaagtcctg

SEQ ID NO: 4401 - DNA, 17 bp, Artificial sequence
  Synthetic oligonucleotide
ctgacatggtaagtcct

SEQ ID NO: 4402 - DNA, 17 bp, Artificial sequence
  Synthetic oligonucleotide
actgacatggtaagtcc

SEQ ID NO: 4403 - DNA, 17 bp, Artificial sequence
  Synthetic oligonucleotide
cactgacatggtaagtc

SEQ ID NO: 4404 - DNA, 17 bp, Artificial sequence
  Synthetic oligonucleotide
tctgccatttaatgagc

SEQ ID NO: 4405 - DNA, 17 bp, Artificial sequence
  Synthetic oligonucleotide
ctctgccatttaatgag

SEQ ID NO: 4406 - DNA, 17 bp, Artificial sequence
  Synthetic oligonucleotide
actctgccatttaatga

SEQ ID NO: 4407 - DNA, 17 bp, Artificial sequence
  Synthetic oligonucleotide
ccaactctgccatttaa

SEQ ID NO: 4408 - DNA, 17 bp, Artificial sequence
  Synthetic oligonucleotide
cccaactctgccattta

SEQ ID NO: 4409 - DNA, 17 bp, Artificial sequence
  Synthetic oligonucleotide
tcccaactctgccattt

SEQ ID NO: 4410 - DNA, 17 bp, Artificial sequence
  Synthetic oligonucleotide
agggttcatggatcccc

SEQ ID NO: 4411 - DNA, 17 bp, Artificial sequence
  Synthetic oligonucleotide
aagggttcatggatccc

SEQ ID NO: 4412 - DNA, 17 bp, Artificial sequence
  Synthetic oligonucleotide
taagggttcatggatcc

SEQ ID NO: 4413 - DNA, 17 bp, Artificial sequence
  Synthetic oligonucleotide
ctggagtccctgggttc

SEQ ID NO: 4414 - DNA, 17 bp, Artificial sequence
  Synthetic oligonucleotide
gctggagtccctgggtt

SEQ ID NO: 4415 - DNA, 17 bp, Artificial sequence
  Synthetic oligonucleotide
ggctggagtccctgggt

SEQ ID NO: 4416 - DNA, 17 bp, Artificial sequence
  Synthetic oligonucleotide
agccaggcccagaccca

SEQ ID NO: 4417 - DNA, 17 bp, Artificial sequence
  Synthetic oligonucleotide
cagccaggcccagaccc

SEQ ID NO: 4418 - DNA, 17 bp, Artificial sequence
  Synthetic oligonucleotide
ccagccaggcccagacc

SEQ ID NO: 4419 - DNA, 17 bp, Artificial sequence
  Synthetic oligonucleotide
ggtgttctacaagctgc

SEQ ID NO: 4420 - DNA, 17 bp, Artificial sequence
  Synthetic oligonucleotide
tggtgttctacaagctg

SEQ ID NO: 4421 - DNA, 17 bp, Artificial sequence
  Synthetic oligonucleotide
ctggtgttctacaagct

SEQ ID NO: 4422 - DNA, 17 bp, Artificial sequence
  Synthetic oligonucleotide
gagctggtgttctacaa

SEQ ID NO: 4423 - DNA, 17 bp, Artificial sequence
  Synthetic oligonucleotide
tgagctggtgttctaca

SEQ ID NO: 4424 - DNA, 17 bp, Artificial sequence
  Synthetic oligonucleotide
gtgagctggtgttctac

SEQ ID NO: 4425 - DNA, 17 bp, Artificial sequence
  Synthetic oligonucleotide
gatcaattattaaccta

SEQ ID NO: 4426 - DNA, 17 bp, Artificial sequence
  Synthetic oligonucleotide
tgatcaattattaacct

SEQ ID NO: 4427 - DNA, 17 bp, Artificial sequence
  Synthetic oligonucleotide
ctgatcaattattaacc

SEQ ID NO: 4428 - DNA, 17 bp, Artificial sequence
  Synthetic oligonucleotide
gcaggtactcatgtttg

SEQ ID NO: 4429 - DNA, 17 bp, Artificial sequence
  Synthetic oligonucleotide
agcaggtactcatgttt

SEQ ID NO: 4430 - DNA, 17 bp, Artificial sequence
  Synthetic oligonucleotide
cagcaggtactcatgtt

SEQ ID NO: 4431 - DNA, 17 bp, Artificial sequence
  Synthetic oligonucleotide
ccaatatcatactatct

SEQ ID NO: 4432 - DNA, 17 bp, Artificial sequence
  Synthetic oligonucleotide
cccaatatcatactatc

SEQ ID NO: 4433 - DNA, 17 bp, Artificial sequence
  Synthetic oligonucleotide
ccccaatatcatactat

SEQ ID NO: 4434 - DNA, 17 bp, Artificial sequence
  Synthetic oligonucleotide
aacctttaaggcctatc

SEQ ID NO: 4435 - DNA, 17 bp, Artificial sequence
  Synthetic oligonucleotide
caacctttaaggcctat

SEQ ID NO: 4436 - DNA, 17 bp, Artificial sequence
  Synthetic oligonucleotide
ccaacctttaaggccta

SEQ ID NO: 4437 - DNA, 17 bp, Artificial sequence
  Synthetic oligonucleotide
cccaacctttaaggcct

SEQ ID NO: 4438 - DNA, 17 bp, Artificial sequence
  Synthetic oligonucleotide
attttttacccaacctt

SEQ ID NO: 4439 - DNA, 17 bp, Artificial sequence
  Synthetic oligonucleotide
cattttttacccaacct

SEQ ID NO: 4440 - DNA, 17 bp, Artificial sequence
  Synthetic oligonucleotide
ccattttttacccaacc

SEQ ID NO: 4441 - DNA, 17 bp, Artificial sequence
  Synthetic oligonucleotide
tccattttttacccaac

SEQ ID NO: 4442 - DNA, 17 bp, Artificial sequence
  Synthetic oligonucleotide
ttccattttttacccaa

SEQ ID NO: 4443 - DNA, 17 bp, Artificial sequence
  Synthetic oligonucleotide
gctttagaaattcacca

SEQ ID NO: 4444 - DNA, 17 bp, Artificial sequence
  Synthetic oligonucleotide
ggctttagaaattcacc

SEQ ID NO: 4445 - DNA, 17 bp, Artificial sequence
  Synthetic oligonucleotide
aggctttagaaattcac

SEQ ID NO: 4446 - DNA, 17 bp, Artificial sequence
  Synthetic oligonucleotide
tggacaagtcctgccca

SEQ ID NO: 4447 - DNA, 17 bp, Artificial sequence
  Synthetic oligonucleotide
ctggacaagtcctgccc

SEQ ID NO: 4448 - DNA, 17 bp, Artificial sequence
  Synthetic oligonucleotide
cctggacaagtcctgcc

SEQ ID NO: 4449 - DNA, 17 bp, Artificial sequence
  Synthetic oligonucleotide
gcctggacaagtcctgc

SEQ ID NO: 4450 - DNA, 17 bp, Artificial sequence
  Synthetic oligonucleotide
agcctggacaagtcctg

SEQ ID NO: 4451 - DNA, 17 bp, Artificial sequence
  Synthetic oligonucleotide
actagactatgcagcct

SEQ ID NO: 4452 - DNA, 17 bp, Artificial sequence
  Synthetic oligonucleotide
tactagactatgcagcc

SEQ ID NO: 4453 - DNA, 17 bp, Artificial sequence
  Synthetic oligonucleotide
atactagactatgcagc

SEQ ID NO: 4454 - DNA, 17 bp, Artificial sequence
  Synthetic oligonucleotide
catactagactatgcag

SEQ ID NO: 4455 - DNA, 17 bp, Artificial sequence
  Synthetic oligonucleotide
tcatactagactatgca

SEQ ID NO: 4456 - DNA, 17 bp, Artificial sequence
  Synthetic oligonucleotide
atcatactagactatgc

SEQ ID NO: 4457 - DNA, 17 bp, Artificial sequence
  Synthetic oligonucleotide
catcatactagactatg

SEQ ID NO: 4458 - DNA, 17 bp, Artificial sequence
  Synthetic oligonucleotide
ccatcatactagactat

SEQ ID NO: 4459 - DNA, 17 bp, Artificial sequence
  Synthetic oligonucleotide
gccatcatactagacta

SEQ ID NO: 4460 - DNA, 17 bp, Artificial sequence
  Synthetic oligonucleotide
tgccatcatactagact

SEQ ID NO: 4461 - DNA, 17 bp, Artificial sequence
  Synthetic oligonucleotide
ttgccatcatactagac

SEQ ID NO: 4462 - DNA, 17 bp, Artificial sequence
  Synthetic oligonucleotide
gttgccatcatactaga

SEQ ID NO: 4463 - DNA, 17 bp, Artificial sequence
  Synthetic oligonucleotide
atgttgccatcatacta

SEQ ID NO: 4464 - DNA, 17 bp, Artificial sequence
  Synthetic oligonucleotide
aatgttgccatcatact

SEQ ID NO: 4465 - DNA, 17 bp, Artificial sequence
  Synthetic oligonucleotide
caatgttgccatcatac

SEQ ID NO: 4466 - DNA, 17 bp, Artificial sequence
  Synthetic oligonucleotide
gcaatgttgccatcata

SEQ ID NO: 4467 - DNA, 17 bp, Artificial sequence
  Synthetic oligonucleotide
tgcaatgttgccatcat

SEQ ID NO: 4468 - DNA, 17 bp, Artificial sequence
  Synthetic oligonucleotide
ttgcaatgttgccatca

SEQ ID NO: 4469 - DNA, 17 bp, Artificial sequence
  Synthetic oligonucleotide
gttgcaatgttgccatc

SEQ ID NO: 4470 - DNA, 17 bp, Artificial sequence
  Synthetic oligonucleotide
ggttgcaatgttgccat

SEQ ID NO: 4471 - DNA, 17 bp, Artificial sequence
  Synthetic oligonucleotide
tggttgcaatgttgcca

SEQ ID NO: 4472 - DNA, 17 bp, Artificial sequence
  Synthetic oligonucleotide
gtggttgcaatgttgcc

SEQ ID NO: 4473 - DNA, 17 bp, Artificial sequence
  Synthetic oligonucleotide
ggtggttgcaatgttgc

SEQ ID NO: 4474 - DNA, 17 bp, Artificial sequence
  Synthetic oligonucleotide
ctggatggtggttgcaa

SEQ ID NO: 4475 - DNA, 17 bp, Artificial sequence
  Synthetic oligonucleotide
cctggatggtggttgca

SEQ ID NO: 4476 - DNA, 17 bp, Artificial sequence
  Synthetic oligonucleotide
gcctggatggtggttgc

SEQ ID NO: 4477 - DNA, 17 bp, Artificial sequence
  Synthetic oligonucleotide
agcctggatggtggttg

SEQ ID NO: 4478 - DNA, 17 bp, Artificial sequence
  Synthetic oligonucleotide
gagatctccagcagcaa

SEQ ID NO: 4479 - DNA, 17 bp, Artificial sequence
  Synthetic oligonucleotide
tgagatctccagcagca

SEQ ID NO: 4480 - DNA, 17 bp, Artificial sequence
  Synthetic oligonucleotide
ctgagatctccagcagc

SEQ ID NO: 4481 - DNA, 17 bp, Artificial sequence
  Synthetic oligonucleotide
actgagatctccagcag

SEQ ID NO: 4482 - DNA, 17 bp, Artificial sequence
  Synthetic oligonucleotide
ggagtgacagggcagga

SEQ ID NO: 4483 - DNA, 17 bp, Artificial sequence
  Synthetic oligonucleotide
tggagtgacagggcagg

SEQ ID NO: 4484 - DNA, 17 bp, Artificial sequence
  Synthetic oligonucleotide
atggagtgacagggcag

SEQ ID NO: 4485 - DNA, 17 bp, Artificial sequence
  Synthetic oligonucleotide
aagtctatcaggatgca

SEQ ID NO: 4486 - DNA, 17 bp, Artificial sequence
  Synthetic oligonucleotide
aaagtctatcaggatgc

SEQ ID NO: 4487 - DNA, 17 bp, Artificial sequence
  Synthetic oligonucleotide
caaagtctatcaggatg

SEQ ID NO: 4488 - DNA, 17 bp, Artificial sequence
  Synthetic oligonucleotide
acaaagtctatcaggat

SEQ ID NO: 4489 - DNA, 17 bp, Artificial sequence
  Synthetic oligonucleotide
tgacaaagtctatcagg

SEQ ID NO: 4490 - DNA, 17 bp, Artificial sequence
  Synthetic oligonucleotide
gtgacaaagtctatcag

SEQ ID NO: 4491 - DNA, 17 bp, Artificial sequence
  Synthetic oligonucleotide
agtgacaaagtctatca

SEQ ID NO: 4492 - DNA, 17 bp, Artificial sequence
  Synthetic oligonucleotide
cctagtgccccagggag

SEQ ID NO: 4493 - DNA, 17 bp, Artificial sequence
  Synthetic oligonucleotide
tcctagtgccccaggga

SEQ ID NO: 4494 - DNA, 17 bp, Artificial sequence
  Synthetic oligonucleotide
gtcctagtgccccaggg

SEQ ID NO: 4495 - DNA, 17 bp, Artificial sequence
  Synthetic oligonucleotide
tgtcctagtgccccagg

SEQ ID NO: 4496 - DNA, 17 bp, Artificial sequence
  Synthetic oligonucleotide
ggtattctgctcataaa

SEQ ID NO: 4497 - DNA, 17 bp, Artificial sequence
  Synthetic oligonucleotide
gggtattctgctcataa

SEQ ID NO: 4498 - DNA, 17 bp, Artificial sequence
  Synthetic oligonucleotide
agggtattctgctcata

SEQ ID NO: 4499 - DNA, 17 bp, Artificial sequence
  Synthetic oligonucleotide
aagggtattctgctcat

SEQ ID NO: 4500 - DNA, 17 bp, Artificial sequence
  Synthetic oligonucleotide
taagggtattctgctca

SEQ ID NO: 4501 - DNA, 17 bp, Artificial sequence
  Synthetic oligonucleotide
gtaagggtattctgctc

SEQ ID NO: 4502 - DNA, 17 bp, Artificial sequence
  Synthetic oligonucleotide
agtaagggtattctgct

SEQ ID NO: 4503 - DNA, 17 bp, Artificial sequence
  Synthetic oligonucleotide
gagacaatgagtaaggg

SEQ ID NO: 4504 - DNA, 17 bp, Artificial sequence
  Synthetic oligonucleotide
agagacaatgagtaagg

SEQ ID NO: 4505 - DNA, 17 bp, Artificial sequence
  Synthetic oligonucleotide
gagagacaatgagtaag

SEQ ID NO: 4506 - DNA, 17 bp, Artificial sequence
  Synthetic oligonucleotide
aagcgacagccctgtgc

SEQ ID NO: 4507 - DNA, 17 bp, Artificial sequence
  Synthetic oligonucleotide
caagcgacagccctgtg

SEQ ID NO: 4508 - DNA, 17 bp, Artificial sequence
  Synthetic oligonucleotide
acaagcgacagccctgt

SEQ ID NO: 4509 - DNA, 17 bp, Artificial sequence
  Synthetic oligonucleotide
aatgagacaggcagccc

SEQ ID NO: 4510 - DNA, 17 bp, Artificial sequence
  Synthetic oligonucleotide
gaatgagacaggcagcc

SEQ ID NO: 4511 - DNA, 17 bp, Artificial sequence
  Synthetic oligonucleotide
agaatgagacaggcagc

SEQ ID NO: 4512 - DNA, 17 bp, Artificial sequence
  Synthetic oligonucleotide
ctctgtgggctcctcca

SEQ ID NO: 4513 - DNA, 17 bp, Artificial sequence
  Synthetic oligonucleotide
gctctgtgggctcctcc

SEQ ID NO: 4514 - DNA, 17 bp, Artificial sequence
  Synthetic oligonucleotide
tgctctgtgggctcctc

SEQ ID NO: 4515 - DNA, 17 bp, Artificial sequence
  Synthetic oligonucleotide
gtgctctgtgggctcct

SEQ ID NO: 4516 - DNA, 17 bp, Artificial sequence
  Synthetic oligonucleotide
tgtgctctgtgggctcc

SEQ ID NO: 4517 - DNA, 17 bp, Artificial sequence
  Synthetic oligonucleotide
ccctgtgctctgtgggc

SEQ ID NO: 4518 - DNA, 17 bp, Artificial sequence
  Synthetic oligonucleotide
gccctgtgctctgtggg

SEQ ID NO: 4519 - DNA, 17 bp, Artificial sequence
  Synthetic oligonucleotide
ggccctgtgctctgtgg

SEQ ID NO: 4520 - DNA, 17 bp, Artificial sequence
  Synthetic oligonucleotide
ccactgtcagtctctcc

SEQ ID NO: 4521 - DNA, 17 bp, Artificial sequence
  Synthetic oligonucleotide
cccactgtcagtctctc

SEQ ID NO: 4522 - DNA, 17 bp, Artificial sequence
  Synthetic oligonucleotide
ccccactgtcagtctct

SEQ ID NO: 4523 - DNA, 17 bp, Artificial sequence
  Synthetic oligonucleotide
cttggctgcaagctctg

SEQ ID NO: 4524 - DNA, 17 bp, Artificial sequence
  Synthetic oligonucleotide
ccttggctgcaagctct

SEQ ID NO: 4525 - DNA, 17 bp, Artificial sequence
  Synthetic oligonucleotide
gccttggctgcaagctc

SEQ ID NO: 4526 - DNA, 20 bp, Artificial sequence
  Synthetic oligonucleotide
gcattcttgccaggcatgga

SEQ ID NO: 4527 - DNA, 20 bp, Artificial sequence
  Synthetic oligonucleotide
ctgcattcttgccaggcatg

SEQ ID NO: 4528 - DNA, 20 bp, Artificial sequence
  Synthetic oligonucleotide
actgcattcttgccaggcat

SEQ ID NO: 4529 - DNA, 20 bp, Artificial sequence
  Synthetic oligonucleotide
tgactgcattcttgccaggc

SEQ ID NO: 4530 - DNA, 20 bp, Artificial sequence
  Synthetic oligonucleotide
gtgactgcattcttgccagg

SEQ ID NO: 4531 - DNA, 20 bp, Artificial sequence
  Synthetic oligonucleotide
gggtgactgcattcttgcca

SEQ ID NO: 4532 - DNA, 20 bp, Artificial sequence
  Synthetic oligonucleotide
agggtgactgcattcttgcc

SEQ ID NO: 4533 - DNA, 20 bp, Artificial sequence
  Synthetic oligonucleotide
cagggtgactgcattcttgc

SEQ ID NO: 4534 - DNA, 20 bp, Artificial sequence
  Synthetic oligonucleotide
cgcagggtgactgcattctt

SEQ ID NO: 4535 - DNA, 20 bp, Artificial sequence
  Synthetic oligonucleotide
ccgcagggtgactgcattct

SEQ ID NO: 4536 - DNA, 20 bp, Artificial sequence
  Synthetic oligonucleotide
ttccgcagggtgactgcatt

SEQ ID NO: 4537 - DNA, 20 bp, Artificial sequence
  Synthetic oligonucleotide
gttccgcagggtgactgcat

SEQ ID NO: 4538 - DNA, 20 bp, Artificial sequence
  Synthetic oligonucleotide
ggttccgcagggtgactgca

SEQ ID NO: 4539 - DNA, 20 bp, Artificial sequence
  Synthetic oligonucleotide
gcggttccgcagggtgactg

SEQ ID NO: 4540 - DNA, 20 bp, Artificial sequence
  Synthetic oligonucleotide
tgcggttccgcagggtgact

SEQ ID NO: 4541 - DNA, 20 bp, Artificial sequence
  Synthetic oligonucleotide
cttgcggttccgcagggtga

SEQ ID NO: 4542 - DNA, 20 bp, Artificial sequence
  Synthetic oligonucleotide
ccttgcggttccgcagggtg

SEQ ID NO: 4543 - DNA, 20 bp, Artificial sequence
  Synthetic oligonucleotide
gcccttgcggttccgcaggg

SEQ ID NO: 4544 - DNA, 20 bp, Artificial sequence
  Synthetic oligonucleotide
agcccttgcggttccgcagg

SEQ ID NO: 4545 - DNA, 20 bp, Artificial sequence
  Synthetic oligonucleotide
aaagcccttgcggttccgca

SEQ ID NO: 4546 - DNA, 20 bp, Artificial sequence
  Synthetic oligonucleotide
caaagcccttgcggttccgc

SEQ ID NO: 4547 - DNA, 20 bp, Artificial sequence
  Synthetic oligonucleotide
cacaaagcccttgcggttcc

SEQ ID NO: 4548 - DNA, 20 bp, Artificial sequence
  Synthetic oligonucleotide
tcacaaagcccttgcggttc

SEQ ID NO: 4549 - DNA, 20 bp, Artificial sequence
  Synthetic oligonucleotide
tttcacaaagcccttgcggt

SEQ ID NO: 4550 - DNA, 20 bp, Artificial sequence
  Synthetic oligonucleotide
gtttcacaaagcccttgcgg

SEQ ID NO: 4551 - DNA, 20 bp, Artificial sequence
  Synthetic oligonucleotide
cagtttcacaaagcccttgc

SEQ ID NO: 4552 - DNA, 20 bp, Artificial sequence
  Synthetic oligonucleotide
ccagtttcacaaagcccttg

SEQ ID NO: 4553 - DNA, 20 bp, Artificial sequence
  Synthetic oligonucleotide
ggccagtttcacaaagccct

SEQ ID NO: 4554 - DNA, 20 bp, Artificial sequence
  Synthetic oligonucleotide
gggccagtttcacaaagccc

SEQ ID NO: 4555 - DNA, 20 bp, Artificial sequence
  Synthetic oligonucleotide
cagggccagtttcacaaagc

SEQ ID NO: 4556 - DNA, 20 bp, Artificial sequence
  Synthetic oligonucleotide
gcagggccagtttcacaaag

SEQ ID NO: 4557 - DNA, 20 bp, Artificial sequence
  Synthetic oligonucleotide
ttcattctctccaaaggagt

SEQ ID NO: 4558 - DNA, 20 bp, Artificial sequence
  Synthetic oligonucleotide
cttcattctctccaaaggag

SEQ ID NO: 4559 - DNA, 20 bp, Artificial sequence
  Synthetic oligonucleotide
cacttcattctctccaaagg

SEQ ID NO: 4560 - DNA, 20 bp, Artificial sequence
  Synthetic oligonucleotide
acacttcattctctccaaag

SEQ ID NO: 4561 - DNA, 20 bp, Artificial sequence
  Synthetic oligonucleotide
tacacttcattctctccaaa

SEQ ID NO: 4562 - DNA, 20 bp, Artificial sequence
  Synthetic oligonucleotide
tgtacacttcattctctcca

SEQ ID NO: 4563 - DNA, 20 bp, Artificial sequence
  Synthetic oligonucleotide
ttgtacacttcattctctcc

SEQ ID NO: 4564 - DNA, 20 bp, Artificial sequence
  Synthetic oligonucleotide
gcttgtacacttcattctct

SEQ ID NO: 4565 - DNA, 20 bp, Artificial sequence
  Synthetic oligonucleotide
tgcttgtacacttcattctc

SEQ ID NO: 4566 - DNA, 20 bp, Artificial sequence
  Synthetic oligonucleotide
cctgcttgtacacttcattc

SEQ ID NO: 4567 - DNA, 20 bp, Artificial sequence
  Synthetic oligonucleotide
acctgcttgtacacttcatt

SEQ ID NO: 4568 - DNA, 20 bp, Artificial sequence
  Synthetic oligonucleotide
cacctgcttgtacacttcat

SEQ ID NO: 4569 - DNA, 20 bp, Artificial sequence
  Synthetic oligonucleotide
atcacctgcttgtacacttc

SEQ ID NO: 4570 - DNA, 20 bp, Artificial sequence
  Synthetic oligonucleotide
gatcacctgcttgtacactt

SEQ ID NO: 4571 - DNA, 20 bp, Artificial sequence
  Synthetic oligonucleotide
aagatcacctgcttgtacac

SEQ ID NO: 4572 - DNA, 20 bp, Artificial sequence
  Synthetic oligonucleotide
gaagatcacctgcttgtaca

SEQ ID NO: 4573 - DNA, 20 bp, Artificial sequence
  Synthetic oligonucleotide
tcgaagatcacctgcttgta

SEQ ID NO: 4574 - DNA, 20 bp, Artificial sequence
  Synthetic oligonucleotide
ctcgaagatcacctgcttgt

SEQ ID NO: 4575 - DNA, 20 bp, Artificial sequence
  Synthetic oligonucleotide
tcctcgaagatcacctgctt

SEQ ID NO: 4576 - DNA, 20 bp, Artificial sequence
  Synthetic oligonucleotide
ctcctcgaagatcacctgct

SEQ ID NO: 4577 - DNA, 20 bp, Artificial sequence
  Synthetic oligonucleotide
ccctcctcgaagatcacctg

SEQ ID NO: 4578 - DNA, 20 bp, Artificial sequence
  Synthetic oligonucleotide
gccctcctcgaagatcacct

SEQ ID NO: 4579 - DNA, 20 bp, Artificial sequence
  Synthetic oligonucleotide
gagccctcctcgaagatcac

SEQ ID NO: 4580 - DNA, 20 bp, Artificial sequence
  Synthetic oligonucleotide
ggagccctcctcgaagatca

SEQ ID NO: 4581 - DNA, 20 bp, Artificial sequence
  Synthetic oligonucleotide
caggagccctcctcgaagat

SEQ ID NO: 4582 - DNA, 20 bp, Artificial sequence
  Synthetic oligonucleotide
ccaggagccctcctcgaaga

SEQ ID NO: 4583 - DNA, 20 bp, Artificial sequence
  Synthetic oligonucleotide
ccccaggagccctcctcgaa

SEQ ID NO: 4584 - DNA, 20 bp, Artificial sequence
  Synthetic oligonucleotide
gccccaggagccctcctcga

SEQ ID NO: 4585 - DNA, 20 bp, Artificial sequence
  Synthetic oligonucleotide
cggccccaggagccctcctc

SEQ ID NO: 4586 - DNA, 20 bp, Artificial sequence
  Synthetic oligonucleotide
tcggccccaggagccctcct

SEQ ID NO: 4587 - DNA, 20 bp, Artificial sequence
  Synthetic oligonucleotide
atcggccccaggagccctcc

SEQ ID NO: 4588 - DNA, 20 bp, Artificial sequence
  Synthetic oligonucleotide
ccatcggccccaggagccct

SEQ ID NO: 4589 - DNA, 20 bp, Artificial sequence
  Synthetic oligonucleotide
cccatcggccccaggagccc

SEQ ID NO: 4590 - DNA, 20 bp, Artificial sequence
  Synthetic oligonucleotide
gacccatcggccccaggagc

SEQ ID NO: 4591 - DNA, 20 bp, Artificial sequence
  Synthetic oligonucleotide
ggacccatcggccccaggag

SEQ ID NO: 4592 - DNA, 20 bp, Artificial sequence
  Synthetic oligonucleotide
gtatttctggaacttcttct

SEQ ID NO: 4593 - DNA, 20 bp, Artificial sequence
  Synthetic oligonucleotide
tgtatttctggaacttcttc

SEQ ID NO: 4594 - DNA, 20 bp, Artificial sequence
  Synthetic oligonucleotide
aatgtatttctggaacttct

SEQ ID NO: 4595 - DNA, 20 bp, Artificial sequence
  Synthetic oligonucleotide
caatgtatttctggaacttc

SEQ ID NO: 4596 - DNA, 20 bp, Artificial sequence
  Synthetic oligonucleotide
accaatgtatttctggaact

SEQ ID NO: 4597 - DNA, 20 bp, Artificial sequence
  Synthetic oligonucleotide
aaccaatgtatttctggaac

SEQ ID NO: 4598 - DNA, 20 bp, Artificial sequence
  Synthetic oligonucleotide
aaaccaatgtatttctggaa

SEQ ID NO: 4599 - DNA, 20 bp, Artificial sequence
  Synthetic oligonucleotide
gaaaccaatgtatttctgga

SEQ ID NO: 4600 - DNA, 20 bp, Artificial sequence
  Synthetic oligonucleotide
gcgaaaccaatgtatttctg

SEQ ID NO: 4601 - DNA, 20 bp, Artificial sequence
  Synthetic oligonucleotide
ggcgaaaccaatgtatttct

SEQ ID NO: 4602 - DNA, 20 bp, Artificial sequence
  Synthetic oligonucleotide
gtcggaggagaagaggcctc

SEQ ID NO: 4603 - DNA, 20 bp, Artificial sequence
  Synthetic oligonucleotide
ttcttaaaaaagacctaaca

SEQ ID NO: 4604 - DNA, 20 bp, Artificial sequence
  Synthetic oligonucleotide
ccttcttaaaaaagacctaa

SEQ ID NO: 4605 - DNA, 20 bp, Artificial sequence
  Synthetic oligonucleotide
tccttcttaaaaaagaccta

SEQ ID NO: 4606 - DNA, 20 bp, Artificial sequence
  Synthetic oligonucleotide
ttccttcttaaaaaagacct

SEQ ID NO: 4607 - DNA, 20 bp, Artificial sequence
  Synthetic oligonucleotide
ttttccttcttaaaaaagac

SEQ ID NO: 4608 - DNA, 20 bp, Artificial sequence
  Synthetic oligonucleotide
tttttccttcttaaaaaaga

SEQ ID NO: 4609 - DNA, 20 bp, Artificial sequence
  Synthetic oligonucleotide
ctttttccttcttaaaaaag

SEQ ID NO: 4610 - DNA, 20 bp, Artificial sequence
  Synthetic oligonucleotide
gactttttccttcttaaaaa

SEQ ID NO: 4611 - DNA, 20 bp, Artificial sequence
  Synthetic oligonucleotide
tgactttttccttcttaaaa

SEQ ID NO: 4612 - DNA, 20 bp, Artificial sequence
  Synthetic oligonucleotide
ctgactttttccttcttaaa

SEQ ID NO: 4613 - DNA, 20 bp, Artificial sequence
  Synthetic oligonucleotide
actgactttttccttcttaa

SEQ ID NO: 4614 - DNA, 20 bp, Artificial sequence
  Synthetic oligonucleotide
caccacctagaacagggcaa

SEQ ID NO: 4615 - DNA, 20 bp, Artificial sequence
  Synthetic oligonucleotide
gccaccacctagaacagggc

SEQ ID NO: 4616 - DNA, 20 bp, Artificial sequence
  Synthetic oligonucleotide
agccaccacctagaacaggg

SEQ ID NO: 4617 - DNA, 20 bp, Artificial sequence
  Synthetic oligonucleotide
tagccaccacctagaacagg

SEQ ID NO: 4618 - DNA, 20 bp, Artificial sequence
  Synthetic oligonucleotide
tttagccaccacctagaaca

SEQ ID NO: 4619 - DNA, 20 bp, Artificial sequence
  Synthetic oligonucleotide
atttagccaccacctagaac

SEQ ID NO: 4620 - DNA, 20 bp, Artificial sequence
  Synthetic oligonucleotide
gatttagccaccacctagaa

SEQ ID NO: 4621 - DNA, 20 bp, Artificial sequence
  Synthetic oligonucleotide
agatttagccaccacctaga

SEQ ID NO: 4622 - DNA, 20 bp, Artificial sequence
  Synthetic oligonucleotide
ccagatttagccaccaccta

SEQ ID NO: 4623 - DNA, 20 bp, Artificial sequence
  Synthetic oligonucleotide
cccagatttagccaccacct

SEQ ID NO: 4624 - DNA, 20 bp, Artificial sequence
  Synthetic oligonucleotide
gcccagatttagccaccacc

SEQ ID NO: 4625 - DNA, 20 bp, Artificial sequence
  Synthetic oligonucleotide
ggcccagatttagccaccac

SEQ ID NO: 4626 - DNA, 20 bp, Artificial sequence
  Synthetic oligonucleotide
taggcccagatttagccacc

SEQ ID NO: 4627 - DNA, 20 bp, Artificial sequence
  Synthetic oligonucleotide
ttaggcccagatttagccac

SEQ ID NO: 4628 - DNA, 20 bp, Artificial sequence
  Synthetic oligonucleotide
attaggcccagatttagcca

SEQ ID NO: 4629 - DNA, 20 bp, Artificial sequence
  Synthetic oligonucleotide
gattaggcccagatttagcc

SEQ ID NO: 4630 - DNA, 20 bp, Artificial sequence
  Synthetic oligonucleotide
cagattaggcccagatttag

SEQ ID NO: 4631 - DNA, 20 bp, Artificial sequence
  Synthetic oligonucleotide
ccagattaggcccagattta

SEQ ID NO: 4632 - DNA, 20 bp, Artificial sequence
  Synthetic oligonucleotide
cccagattaggcccagattt

SEQ ID NO: 4633 - DNA, 20 bp, Artificial sequence
  Synthetic oligonucleotide
acccagattaggcccagatt

SEQ ID NO: 4634 - DNA, 20 bp, Artificial sequence
  Synthetic oligonucleotide
ccacccagattaggcccaga

SEQ ID NO: 4635 - DNA, 20 bp, Artificial sequence
  Synthetic oligonucleotide
gccacccagattaggcccag

SEQ ID NO: 4636 - DNA, 20 bp, Artificial sequence
  Synthetic oligonucleotide
agccacccagattaggccca

SEQ ID NO: 4637 - DNA, 20 bp, Artificial sequence
  Synthetic oligonucleotide
gagccacccagattaggccc

SEQ ID NO: 4638 - DNA, 20 bp, Artificial sequence
  Synthetic oligonucleotide
ctgagccacccagattaggc

SEQ ID NO: 4639 - DNA, 20 bp, Artificial sequence
  Synthetic oligonucleotide
gctgagccacccagattagg

SEQ ID NO: 4640 - DNA, 20 bp, Artificial sequence
  Synthetic oligonucleotide
agctgagccacccagattag

SEQ ID NO: 4641 - DNA, 20 bp, Artificial sequence
  Synthetic oligonucleotide
tagctgagccacccagatta

SEQ ID NO: 4642 - DNA, 20 bp, Artificial sequence
  Synthetic oligonucleotide
gttagctgagccacccagat

SEQ ID NO: 4643 - DNA, 20 bp, Artificial sequence
  Synthetic oligonucleotide
ggttagctgagccacccaga

SEQ ID NO: 4644 - DNA, 20 bp, Artificial sequence
  Synthetic oligonucleotide
gaggttagctgagccaccca

SEQ ID NO: 4645 - DNA, 20 bp, Artificial sequence
  Synthetic oligonucleotide
agaggttagctgagccaccc

SEQ ID NO: 4646 - DNA, 20 bp, Artificial sequence
  Synthetic oligonucleotide
gtcacttcaggaagggaaga

SEQ ID NO: 4647 - DNA, 20 bp, Artificial sequence
  Synthetic oligonucleotide
tgtcacttcaggaagggaag

SEQ ID NO: 4648 - DNA, 20 bp, Artificial sequence
  Synthetic oligonucleotide
aaaagtgaatcatctaactg

SEQ ID NO: 4649 - DNA, 20 bp, Artificial sequence
  Synthetic oligonucleotide
aaaaagtgaatcatctaact

SEQ ID NO: 4650 - DNA, 20 bp, Artificial sequence
  Synthetic oligonucleotide
caaaaagtgaatcatctaac

SEQ ID NO: 4651 - DNA, 20 bp, Artificial sequence
  Synthetic oligonucleotide
gcaaaaagtgaatcatctaa

SEQ ID NO: 4652 - DNA, 20 bp, Artificial sequence
  Synthetic oligonucleotide
gggcaaaaagtgaatcatct

SEQ ID NO: 4653 - DNA, 20 bp, Artificial sequence
  Synthetic oligonucleotide
cttgtatgagaagtggcttt

SEQ ID NO: 4654 - DNA, 20 bp, Artificial sequence
  Synthetic oligonucleotide
gcttgtatgagaagtggctt

SEQ ID NO: 4655 - DNA, 20 bp, Artificial sequence
  Synthetic oligonucleotide
gggcttgtatgagaagtggc

SEQ ID NO: 4656 - DNA, 20 bp, Artificial sequence
  Synthetic oligonucleotide
cctgcagtttcaggactaga

SEQ ID NO: 4657 - DNA, 20 bp, Artificial sequence
  Synthetic oligonucleotide
tcctgcagtttcaggactag

SEQ ID NO: 4658 - DNA, 20 bp, Artificial sequence
  Synthetic oligonucleotide
ggtcctgcagtttcaggact

SEQ ID NO: 4659 - DNA, 20 bp, Artificial sequence
  Synthetic oligonucleotide
tggtcctgcagtttcaggac

SEQ ID NO: 4660 - DNA, 20 bp, Artificial sequence
  Synthetic oligonucleotide
ctggtcctgcagtttcagga

SEQ ID NO: 4661 - DNA, 20 bp, Artificial sequence
  Synthetic oligonucleotide
aactggtcctgcagtttcag

SEQ ID NO: 4662 - DNA, 20 bp, Artificial sequence
  Synthetic oligonucleotide
aaactggtcctgcagtttca

SEQ ID NO: 4663 - DNA, 20 bp, Artificial sequence
  Synthetic oligonucleotide
agaaactggtcctgcagttt

SEQ ID NO: 4664 - DNA, 20 bp, Artificial sequence
  Synthetic oligonucleotide
gagaaactggtcctgcagtt

SEQ ID NO: 4665 - DNA, 20 bp, Artificial sequence
  Synthetic oligonucleotide
agagaaactggtcctgcagt

SEQ ID NO: 4666 - DNA, 20 bp, Artificial sequence
  Synthetic oligonucleotide
cagagaaactggtcctgcag

SEQ ID NO: 4667 - DNA, 20 bp, Artificial sequence
  Synthetic oligonucleotide
ggcagagaaactggtcctgc

SEQ ID NO: 4668 - DNA, 20 bp, Artificial sequence
  Synthetic oligonucleotide
tggcagagaaactggtcctg

SEQ ID NO: 4669 - DNA, 20 bp, Artificial sequence
  Synthetic oligonucleotide
ttggcagagaaactggtcct

SEQ ID NO: 4670 - DNA, 20 bp, Artificial sequence
  Synthetic oligonucleotide
cttggcagagaaactggtcc

SEQ ID NO: 4671 - DNA, 20 bp, Artificial sequence
  Synthetic oligonucleotide
cccttggcagagaaactggt

SEQ ID NO: 4672 - DNA, 20 bp, Artificial sequence
  Synthetic oligonucleotide
ccccttggcagagaaactgg

SEQ ID NO: 4673 - DNA, 20 bp, Artificial sequence
  Synthetic oligonucleotide
ctccccttggcagagaaact

SEQ ID NO: 4674 - DNA, 20 bp, Artificial sequence
  Synthetic oligonucleotide
cctccccttggcagagaaac

SEQ ID NO: 4675 - DNA, 20 bp, Artificial sequence
  Synthetic oligonucleotide
tcctccccttggcagagaaa

SEQ ID NO: 4676 - DNA, 20 bp, Artificial sequence
  Synthetic oligonucleotide
actcctccccttggcagaga

SEQ ID NO: 4677 - DNA, 20 bp, Artificial sequence
  Synthetic oligonucleotide
aactcctccccttggcagag

SEQ ID NO: 4678 - DNA, 20 bp, Artificial sequence
  Synthetic oligonucleotide
caactcctccccttggcaga

SEQ ID NO: 4679 - DNA, 20 bp, Artificial sequence
  Synthetic oligonucleotide
tccaactcctccccttggca

What is claimed:
1. An oligomeric compound according to the following chemical structure:
(SEQ ID NO: 1423)
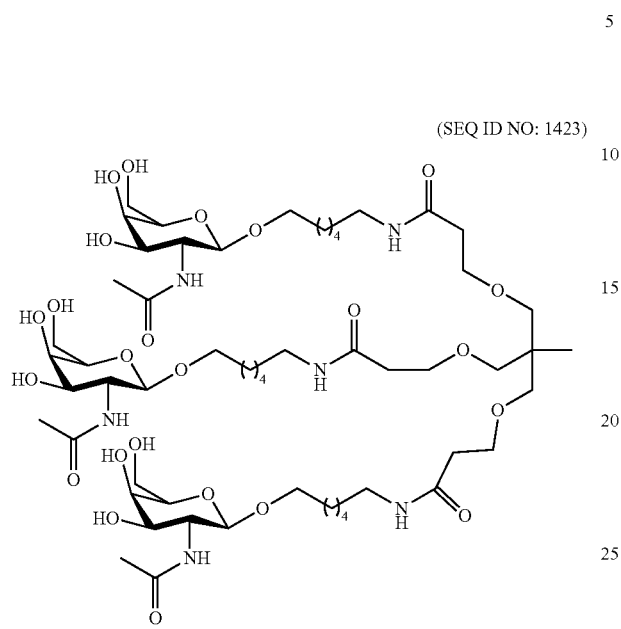
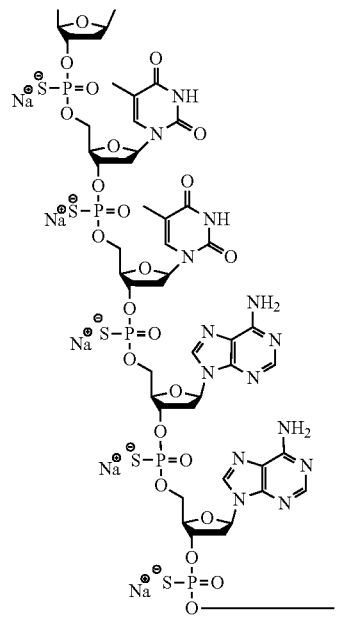
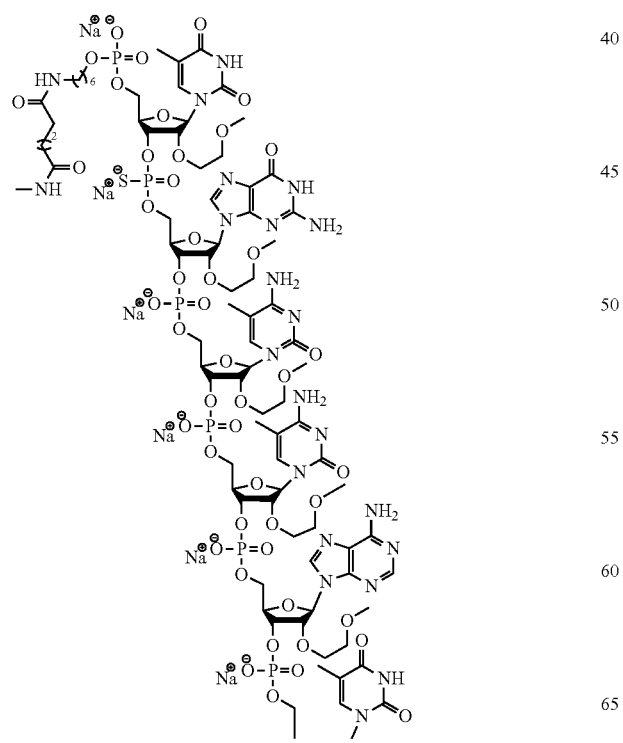

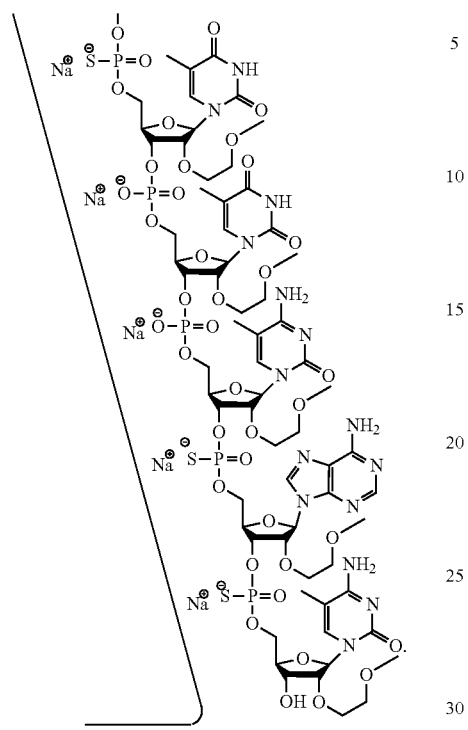
2. An oligomeric compound according to the following chemical structure:
(SEQ ID NO: 1423)
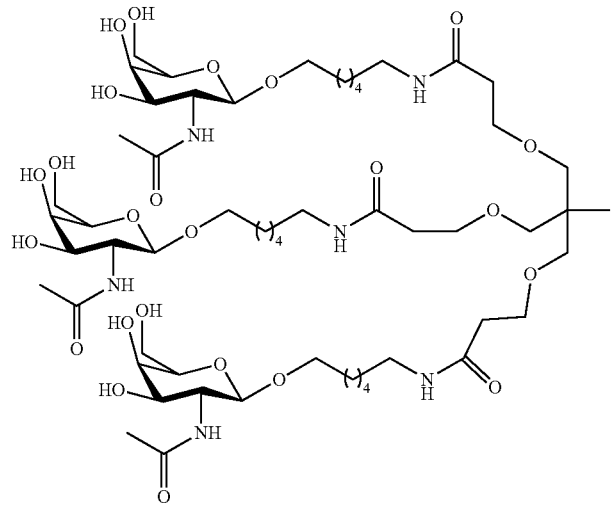

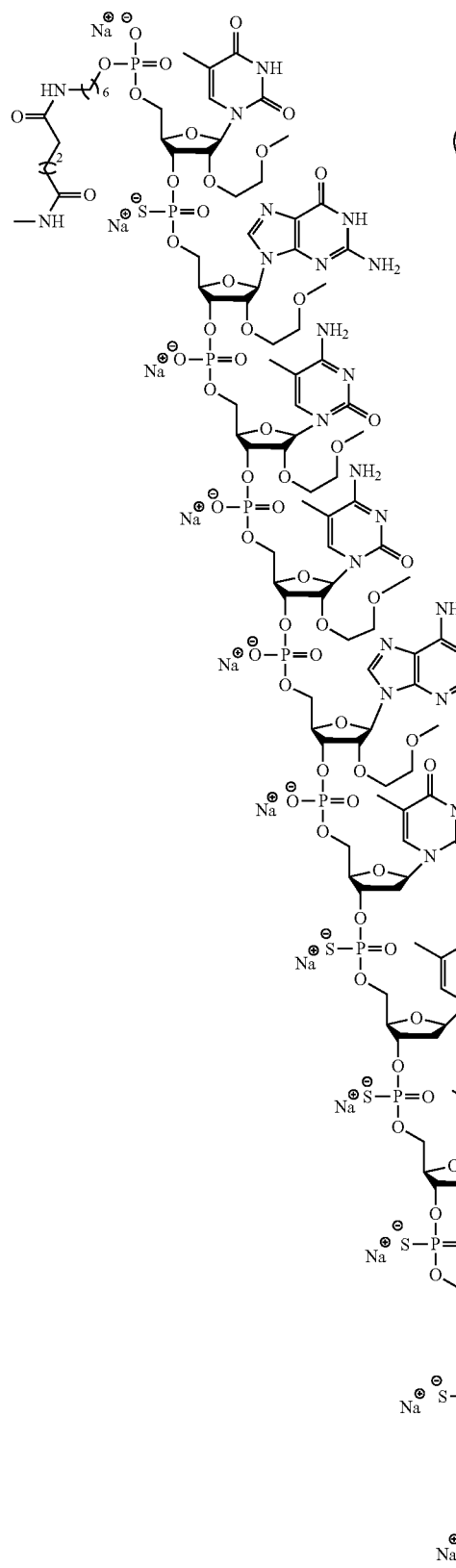
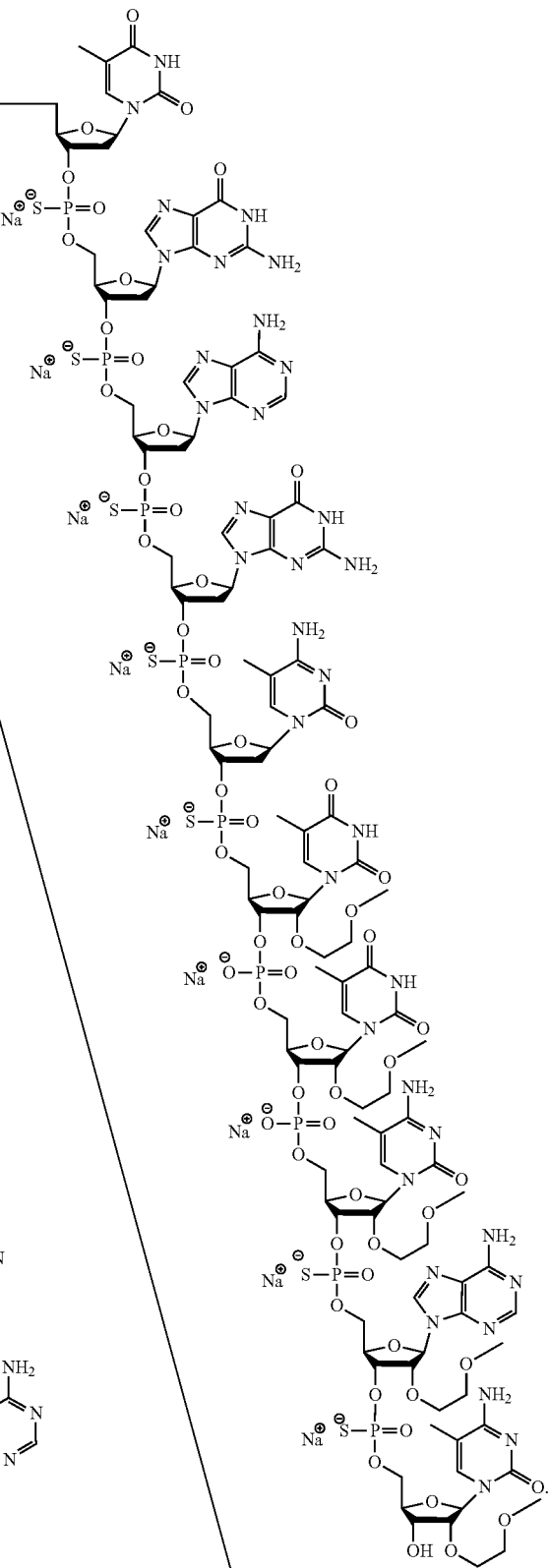
, or salt thereof.

3. A pharmaceutical composition comprising the oligomeric compound of claim 1 and a pharmaceutically acceptable diluent.

4. A pharmaceutical composition comprising the oligomeric compound of claim 2 and a pharmaceutically acceptable diluent.

5. The pharmaceutical composition of claim 3, wherein the pharmaceutically acceptable diluent is water or saline.

6. The pharmaceutical composition of claim 4, wherein the pharmaceutically acceptable diluent is water or saline.

7. The oligomeric compound of claim 2, wherein the oligomeric compound is a salt, and wherein the cation of the salt is sodium or potassium.

* * * * *